US012037378B2

(12) United States Patent
Brannetti et al.

(10) Patent No.: US 12,037,378 B2
(45) Date of Patent: Jul. 16, 2024

(54) VARIANT CD58 DOMAINS AND USES THEREOF

(71) Applicant: NOVARTIS AG, Basel (CH)

(72) Inventors: Barbara Brannetti, Cambridge, MA (US); Dattananda Chelur, Chesterbrook, PA (US); Brian Granda, Salisbury, MA (US); Connie Hong, Somerville, MA (US)

(73) Assignee: Novartis AG, Basel (CH)

( * ) Notice: Subject to any disclaimer, the term of this patent is extended or adjusted under 35 U.S.C. 154(b) by 227 days.

(21) Appl. No.: 17/612,993

(22) PCT Filed: May 19, 2020

(86) PCT No.: PCT/US2020/033566
§ 371 (c)(1),
(2) Date: Nov. 19, 2021

(87) PCT Pub. No.: WO2020/236797
PCT Pub. Date: Nov. 26, 2020

(65) Prior Publication Data
US 2023/0071196 A1 Mar. 9, 2023

Related U.S. Application Data

(60) Provisional application No. 62/854,715, filed on May 30, 2019, provisional application No. 62/850,918, filed on May 21, 2019.

(51) Int. Cl.
*C07K 14/705* (2006.01)
(52) U.S. Cl.
CPC ............... *C07K 14/70528* (2013.01)
(58) Field of Classification Search
CPC ............... A61P 35/00; C07K 14/7051; C07K 14/70528
See application file for complete search history.

(56) References Cited

U.S. PATENT DOCUMENTS 5,798,229 A * 8/1998 Strittmatter ............ C07K 16/30
530/387.3
5,951,983 A 9/1999 Bazin et al.
(Continued)

FOREIGN PATENT DOCUMENTS

RU 2 355 705 C2 5/2009
WO 91/03493 A1 3/1991
(Continued)

OTHER PUBLICATIONS

Dombkowski et al., Protein disulfide engineering. FEBS Lett. Jan. 21, 2014;588(2):206-12. doi: 10.1016/j.febslet.2013.11.024. Epub Nov. 26, 2013. PMID: 24291258 (Year: 2014).*

(Continued)

*Primary Examiner* — Randall L Beane
(74) *Attorney, Agent, or Firm* — Biospark Intellectual Property Law

(57) ABSTRACT

The present disclosure provides CD2 binding molecules that specifically bind to CD2, including monospecific, bispecific and trispecific binding molecules, conjugates comprising the CD2 binding molecules, and pharmaceutical compositions comprising the CD2 binding molecules and the conjugates. The disclosure further provides methods of using the CD2 binding molecules to modulate CD2 signaling in order to treat a variety of immune (e.g., autoimmune), inflammatory and proliferative disorders. The disclosure yet further provides recombinant host cells engineered to express the CD2 binding molecules and methods of producing the CD2 binding molecules by culturing the host cells under conditions in which the CD2 binding molecules are expressed.

16 Claims, 48 Drawing Sheets

Figure 1E:
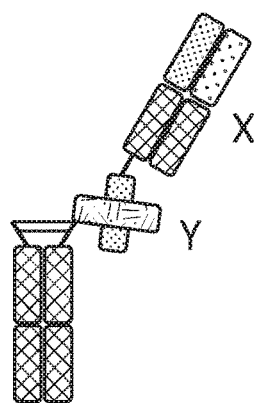

Specification includes a Sequence Listing.

(56) References Cited

U.S. PATENT DOCUMENTS

| | | |
|---|---|---|
| 6,849,258 B1* | 2/2005 | Bazin ................. C07K 16/2806 |
| | | 435/328 |
| 2002/0009446 A1* | 1/2002 | Magilavy ......... C07K 14/70507 |
| | | 435/372.3 |
| 2002/0168360 A1* | 11/2002 | Dingivan ................ A61P 19/02 |
| | | 424/143.1 |
| 2003/0044406 A1* | 3/2003 | Dingivan ................ A61P 17/00 |
| | | 424/130.1 |
| 2005/0175606 A1 | 8/2005 | Huang et al. |
| 2012/0171207 A1* | 7/2012 | Wilcox .................. A61P 37/04 |
| | | 424/134.1 |
| 2016/0095938 A1 | 4/2016 | Fishkin et al. |
| 2017/0037128 A1 | 2/2017 | Little et al. |
| 2021/0139585 A1* | 5/2021 | Granda ............. C07K 16/2809 |
| 2022/0396631 A1* | 12/2022 | Granda ............. C07K 16/2809 |
| 2024/0025993 A1* | 1/2024 | Cebe ................. C07K 16/2806 |

FOREIGN PATENT DOCUMENTS

| | | |
|---|---|---|
| WO | 2004108158 A1 | 12/2004 |
| WO | 2014025198 A2 | 2/2014 |
| WO | 2015142675 A2 | 9/2015 |
| WO | 2016105450 A2 | 6/2016 |
| WO | 2016146702 A1 | 9/2016 |
| WO | 2017027392 A1 | 2/2017 |
| WO | 2018199593 A1 | 11/2018 |
| WO | 2019078697 A2 | 4/2019 |

OTHER PUBLICATIONS

Carter, Bispecific human IgG by design. J Immunol Methods. Feb. 1, 2001;248(1-2):7-15. doi: 10.1016/s0022-1759(00)00339-2. PMID: 11223065 (Year: 2001).*

Tutt A, Stevenson GT, Glennie MJ. "Trispecific F(ab')3 derivatives that use cooperative signaling via the TCR/CD3 complex and CD2 to activate and redirect resting cytotoxic T cells," J Immunol. Jul. 1, 1991;147(1):60-9.

Wong, Way M., et al., Rheumatoid arthritis T cells produce Th1 cytokines in response to stimulation with a novel trispecific antibody directed against CD2, CD3, and CD28, Scandinavian Journal of Rheumatology, vol. 29, Issue 5, pp. 282-287, Published online: Jul. 12, 2009.

Brossay, et al., "Porcine CD58: cDNA cloning and molecular dissection of the porcine CD58-human CD2 interface," Biochem Biophys Res Commun. Oct. 3, 2003;309(4):992-8.

Dombkowski, et al., "Protein disulfide engineering," FEBS Letters, vol. 588, Issue 2, Jan. 21, 2014, pp. 206-212.

* cited by examiner

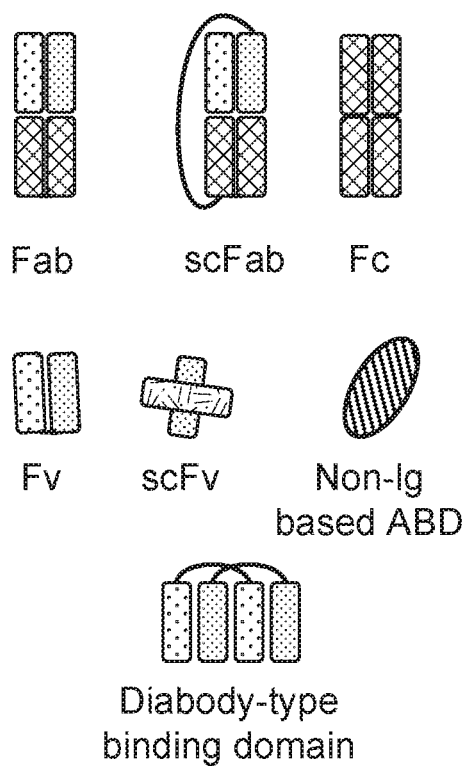
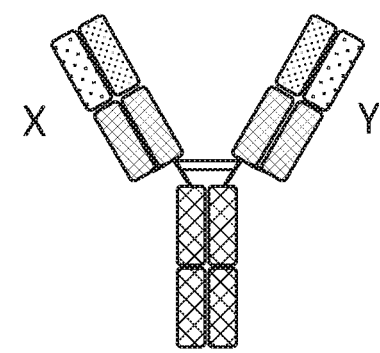
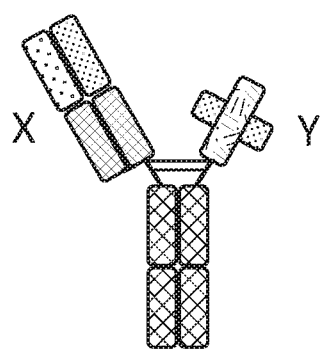
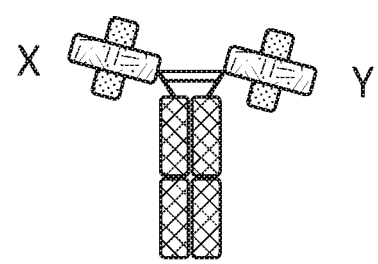
FIG. 1A
FIG. 1B
FIG. 1C
FIG. 1D

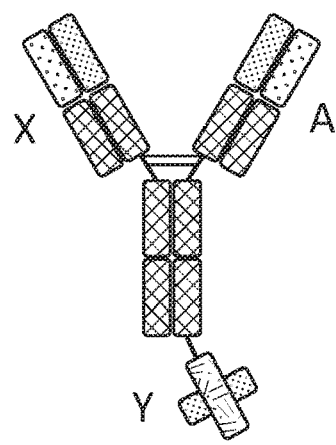
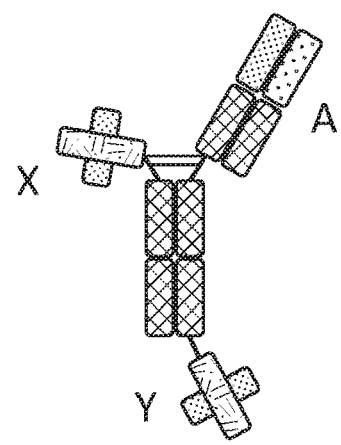
FIG. 1Q  FIG. 1R
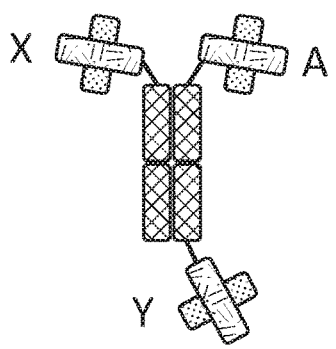
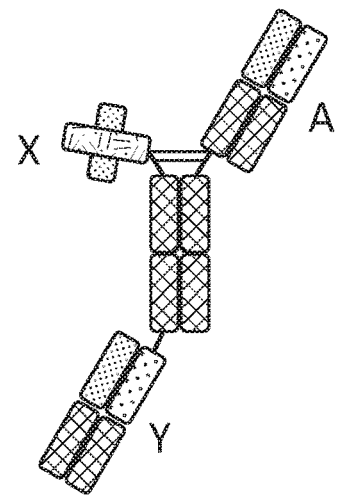
FIG. 1S  FIG. 1T
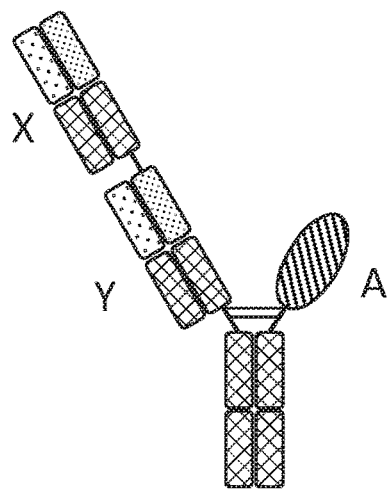
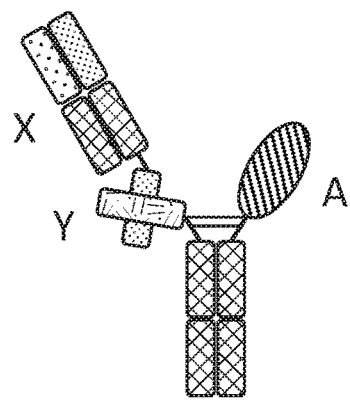
FIG. 1U  FIG. 1V

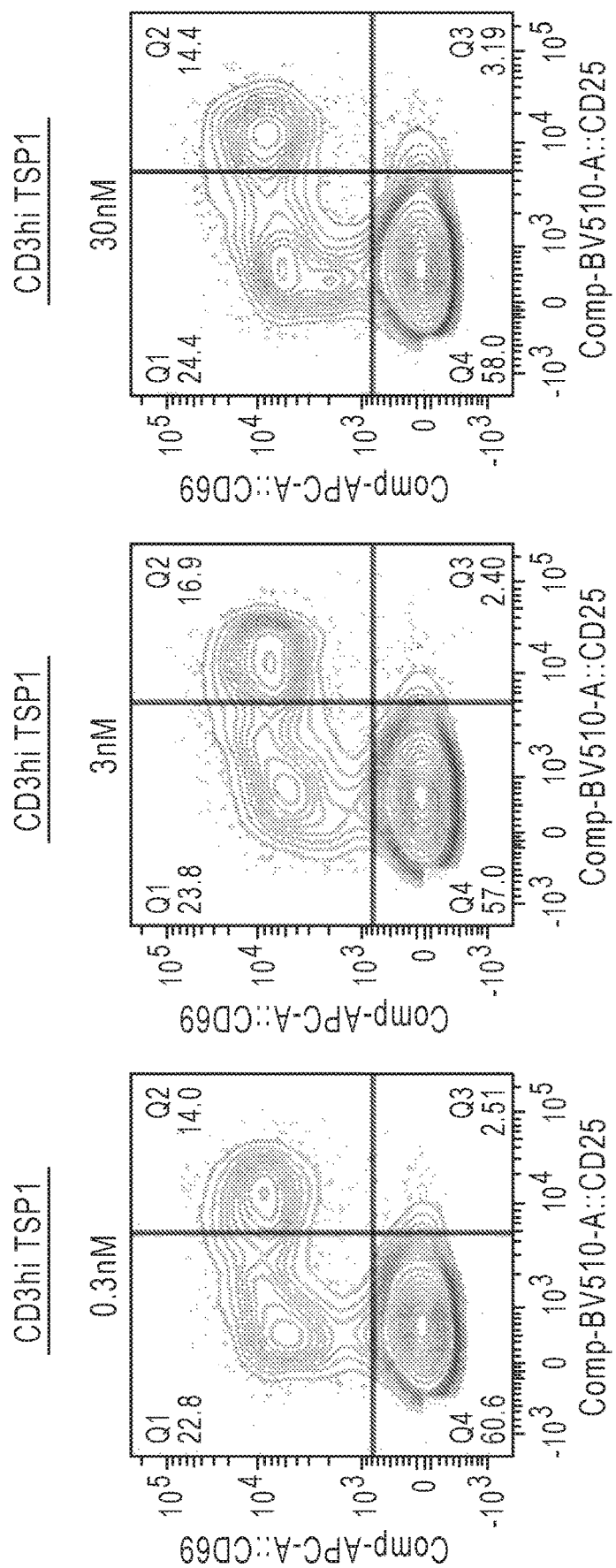

Donor HHU20140811

Donor HHU20140811

Donor 198760

Donor 198760

Donor HHU20140811

Donor 198760

Donor 198760

Donor HHU20140811

Donor 198760

Donor 198760

Donor HHU20140811

Donor HHU20140811

Donor 198760

Donor 198760

Donor D328244

Donor D328244

Donor D327315

Donor D327315

Donor D328244

Donor D327315

VARIANT CD58 DOMAINS AND USES THEREOF

1. CROSS-REFERENCE TO RELATED APPLICATIONS

This application is a U.S. National Phase filing of International Application Serial No. PCT/US2020/033566 filed May 19, 2020, which claims the priority benefit of U.S. provisional application nos. 62/850,918, filed May 21, 2019, and 62/854,715, filed May 30, 2019, the contents of both of which are incorporated herein in their entireties by reference thereto.

2. SEQUENCE LISTING

The instant application contains a Sequence Listing which has been submitted electronically in ASCII format and is hereby incorporated by reference in its entirety. Said ASCII copy, created on May 13, 2020, is named NOV-008WO_SL.txt and is 771,388 bytes in size.

3. FIELD OF INVENTION

The disclosure generally relates to variant CD58 domains and CD2 binding molecules, including monospecific and multispecific molecules, that comprise a variant CD58 domain, and their use for treating proliferative conditions, autoimmune disorders, and inflammatory conditions. The disclosure further relates to CD3 binding molecules.

4. BACKGROUND

CD58, also known as LFA-3, is a glycoprotein expressed on the surfaces of a variety of cell types. CD58 is a ligand for CD2, and this pair of adhesion molecules is involved in immune modulation in a variety of cell types. In particular, the CD2 pathway can directly mediate CD3-independent T cell activation (see, e.g., Ohno et al., 1991, J Immunol 146 (11):3742-3746)) and has a costimulatory role in a variety of immune cell types, such as CD8+ T cells (see, e.g., Leitner et al., 2015, J Immunol 195 (2):477-487) and NK cells (see, e.g., Liu et al., 2016, Cell Reports 15(5):1088-1099).

Due to the involvement of the CD2 pathway in cellular processes associated with immune responses, tumorigenesis and other disease states, there is a need for therapeutic agents that target this pathway. Molecules that modulate CD2 activity are candidate immunosuppressive and/or anti-inflammatory and/or anticancer agents with activity towards (1) autoimmune disorders such as multiple sclerosis; (2) a variety of inflammatory diseases or disorders with an inflammatory or T cell-mediated component such as various forms of arthritis; allograft rejections; asthma; inflammatory diseases of the bowel, including Crohn's disease; various dermatological conditions such as psoriasis; and the like, and (3) a variety of cancers and tumors.

5. SUMMARY

The disclosure provides variant CD58 domains. The variant CD58 domains have been engineered to include a pair of cysteines that are believed to form a disulfide bridge, which confers advantageous properties such as improved stability and reduced aggregation, without sacrificing binding affinity to human CD2 and can be used to modulate the CD2 pathway. The variant CD58 domains also bind to cynomolgus (cyno) CD2 and are therefore useful in animal testing during human therapeutic development.

The variant CD58 domains can, for example when administered in the form of immunoglobulin fusion proteins, inhibit the CD2 pathway similarly to anti-CD2 antibodies and ameliorate autoimmune and inflammatory conditions to which the pathway contributes. See, e.g., Erben et al., 2015, Clinical Immunology 157(1):16-25.

The variant CD58 domains can, for example when administered in the form of multispecific binding molecules, contribute to redirected targeted T-cell lysis (RTCC) of tumor cells, by cross-linking the target cells to an immune cell such as a T cell. When the variant CD58 domains are incorporated into trispecific binding molecules that also target a TCR and a TAA, the cross-linking of a tumor cell that expresses the TAA to a T cell can simultaneously engage both the TCR and CD2 pathways, resulting in more robust T cell activation.

Accordingly, the disclosure provides CD2 binding molecules, including monospecific and multispecific molecules, that comprise a variant CD58 domain. In some embodiments, the CD2 binding molecule is a monospecific binding molecule. For example, the monospecific binding molecule can comprise a variant CD58 domain that is optionally fused to an immunoglobulin domain to allow for dimerization. In other embodiments, the CD2 binding molecule is a multispecific (e.g., bispecific or trispecific) CD2 binding molecule.

In one aspect, the disclosure provides CD2 binding molecules e.g., monospecific or multispecific binding molecules, comprising variant CD58 domains as an antigen binding module ("ABM") that binds to CD2 (sometimes referred to herein as "ABM1" or a "CD2 ABM"). Exemplary CD2 binding molecules are described in Section 7.2, and the variant CD58 domains that they comprise are described in Section 7.3 and specific embodiments 1 to 26, infra. In some embodiments the CD2 binding molecules are fusion polypeptides, e.g., Ig fusions, as exemplified in Section 7.4 and specific embodiments 27 to 29, infra.

In another aspect, the disclosure provides multispecific binding molecules ("MBMs") comprising the CD2 ABMs of the disclosure.

In certain embodiments, the MBMs are bispecific binding molecules ("BBMs"). The BBMs of the disclosure comprise a CD2 ABM comprising the variant CD58 sequences of the disclosure ("ABM1" or "CD2 ABM") and a second ABM that specifically binds to a second antigen ("ABM2"), e.g., component of a human T cell receptor (TCR) complex (sometimes referred to herein as a "TCR ABM") or a human tumor-associated antigen ("TAA") (sometimes referred to herein as a TAA ABM). The terms ABM1, ABM2, CD2 ABM, TCR ABM, and TAA ABM are used merely for convenience and are not intended to convey any particular configuration of a BBM. In some embodiments, a TCR ABM binds to CD3 (referred to herein a "CD3 ABM" or the like). Accordingly, disclosures relating to ABM2 and TCR ABMs are also applicable to CD3 ABMs. Features of exemplary MBMs are described in Sections 7.7 to 7.8 and specific embodiments 30 to 1356, infra.

The present disclosure also extends the principles of RTCC by providing trispecific binding molecules ("TBMs") that engage (i) CD2, (ii) CD3 or other component of a TCR complex on T-cells or a TAA, and (iii) a TAA (or second TAA as the case dictates). The TBMs of the disclosure comprise at least three antigen-binding modules ("ABMs") that can bind (i) CD2 (ABM1), (ii) a component of a TCR complex or a TAA (ABM2), and (iii) a TAA (ABM3). For TBMs of the disclosure that engage CD2 and two TAAs, the two TAAs can be referred to as TAA 1 and TAA 2, and the corresponding ABMs can be referred to as a TAA 1 ABM and a TAA 2 ABM, respectively. Because both TAA 1 and TAA 2 are tumor-associated antigens, the designations of the tumor associated antigens of the disclosure as TAA 1 and TAA 2 are arbitrary—thus, any disclosure pertaining to TAA 1 is applicable to TAA 2 and vice versa, unless the context dictates otherwise.

Without being bound by theory, the inventors believe that combining CD2- and TCR complex-engagement in a TBM of the disclosure can stimulate both a primary signaling pathway that promotes T-cell mediated lysis of tumor cells (by clustering TCRs, for example) and a second co-stimulatory pathway to induce T-cell proliferation and potentially overcome anergy.

In some embodiments, each antigen-binding module of a MBM of the disclosure is capable of binding its respective target at the same time as each of the one or more additional antigen-binding modules is bound to its respective target. ABM1 comprises a variant CD58 domain of the disclosure, while ABM2 and, when present, ABM3 can be immunoglobulin- or non-immunoglobulin-based modules. Therefore the MBMs can include any combination of immunoglobulin- and non-immunoglobulin-based ABMs. Immunoglobulin-based ABMs that can be used in the MBMs are described in Section 7.5.1 and specific embodiments 33 to 207, 607 to 614, 616 to 621, 623 to 792, 919 to 1086, and 1186 to 1240 infra. Non-immunoglobulin-based ABMs that can be used in the MBMs are described in Section 7.5.2 and specific embodiments 793 to 854 and 1087 to 1148, infra. Further features of exemplary ABMs that bind to a component of a TCR complex are described in Section 7.9 and specific embodiments 31 to 621, infra. Further features of exemplary ABMs that bind to TAAs are described in Section 7.10 and specific embodiments 622 to 854 and 917 to 1148, infra.

The ABMs of a MBM (or portions thereof) can be connected to each other, for example, by short peptide linkers or by an Fc domain. Methods and components for connecting ABMs to form a MBM are described in Section 7.6 and specific embodiments 1242 to 1356, infra.

BBMs have at least two ABMs (e.g., a BBM is at least bivalent) and TBMs have at least three ABMs (e.g., a TBM is at least trivalent), but they can have greater valencies. For example, a BBM can have three, four or more ABMs (i.e., is trivalent, tetravalent, or has a valency that is greater than tetravalent). Exemplary bivalent, trivalent, and tetravalent BBM configurations are shown in FIG. 1 and described in Section 7.7 and specific embodiments 857 to 916, infra.

A TBM can have four ABMs (i.e., is tetravalent), five ABMs (i.e., is pentavalent), or six ABMs (i.e., is hexavalent), provided that the TBM has: (a) at least one ABM that can bind CD2, at least one ABM that can bind a component of a TCR complex, and at least one ABM that can bind a TAA; or (b) at least at least one ABM that can bind CD2, at least one ABM that can bind a TAA, and at least one ABM that can bind a second TAA. Exemplary trivalent, tetravalent, pentavalent, and hexavalent TBM configurations are shown in FIG. 2 and described in Section 7.8 and specific embodiments 1149 to 1185 and 1243 to 1246, infra.

The disclosure further provides nucleic acids encoding the CD2 binding molecules (either in a single nucleic acid or a plurality of nucleic acids) and recombinant host cells and cell lines engineered to express the nucleic acids and CD2 binding molecules of the disclosure. Exemplary nucleic acids, host cells, and cell lines are described in Section 7.11 and specific embodiments 1552 to 1558, infra.

The present disclosure further provides drug conjugates comprising the CD2 binding molecules of the disclosure. Such conjugates are referred to herein as "antibody-drug conjugates" or "ADCs" for convenience, notwithstanding that some of the ABMs can be non-immunoglobulin domains. Examples of ADCs are described in Section 7.13 and specific embodiments 1357 to 1395, infra.

Pharmaceutical compositions comprising the CD2 binding molecules and ADCs are also provided. Examples of pharmaceutical compositions are described in Section 7.16 and specific embodiments 1396 and 1427, infra.

Further provided herein are methods of using the CD2 binding molecules, the ADCs, and the pharmaceutical compositions of the disclosure, for example for treating proliferative conditions (e.g., cancers), for treating autoimmune disorders, and for treating inflammatory conditions. Exemplary methods are described in Section 7.17 and specific embodiments 1397 to 1426 and 1428 to 1549, infra.

The disclosure further provides methods of using the CD2 binding molecules, the ADCs, and the pharmaceutical compositions in combination with other agents and therapies. Exemplary agents, therapies, and methods of combination therapy are described in Section 7.18 and specific embodiment 1550, infra.

The disclosure further provides CD3 binding molecules, e.g., MBMs, comprising CDR sequences of the CD3 binder designated CD3-129 in Table 12A and CD3 binding molecules, e.g., MBMs, comprising CDR sequences of the CD3 binder designated CD3-130 in Table 12A. CD3 binding molecules in the form of MBMs can include, for example, a CD2 ABM (e.g., comprising a CD58 moiety described in Section 7.3) and/or a TAA ABM (e.g., as described in Section 7.10). Exemplary CD3 binding molecules are described in specific embodiments 1560 to 1709.

6. BRIEF DESCRIPTION OF THE FIGURES

Figure 1F:
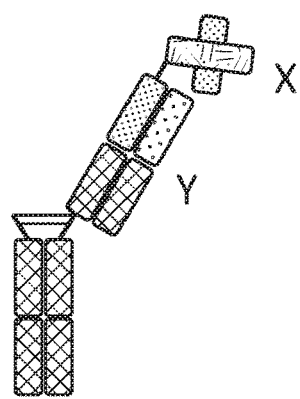
Figure 1G:
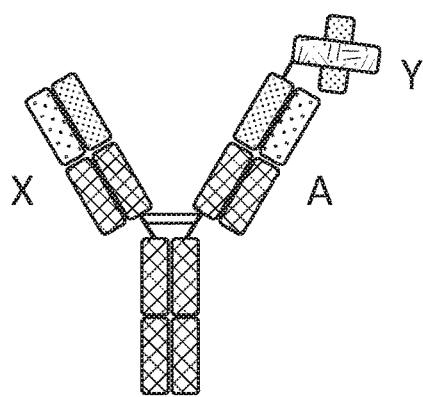
Figure 1H:
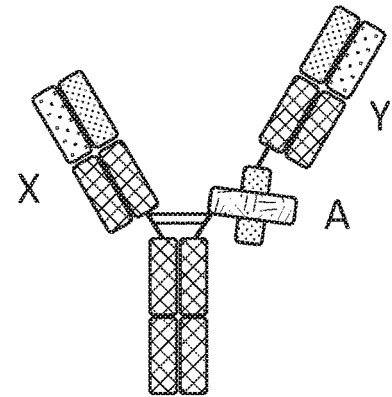
Figure 1I:
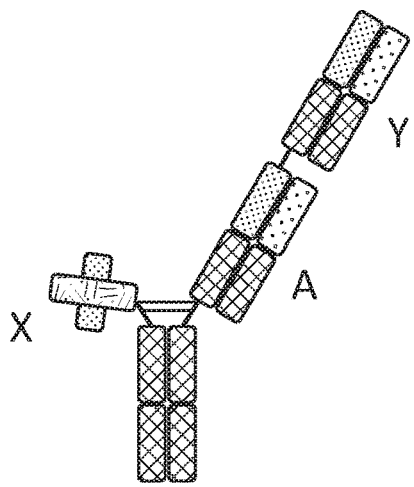
Figure 1J:
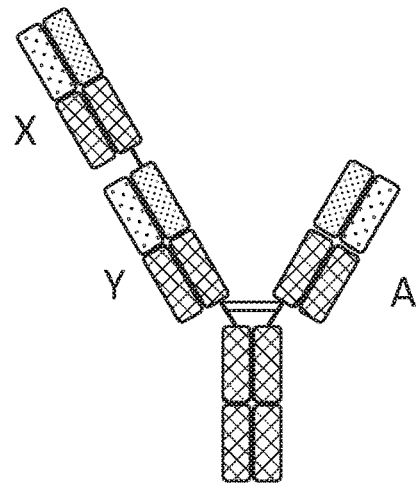
Figure 1K:
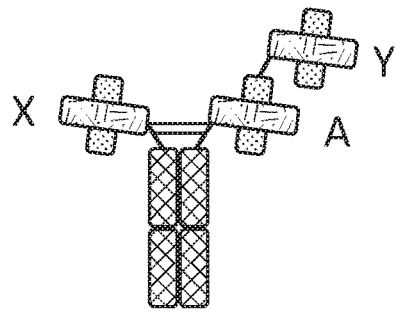
Figure 1L:
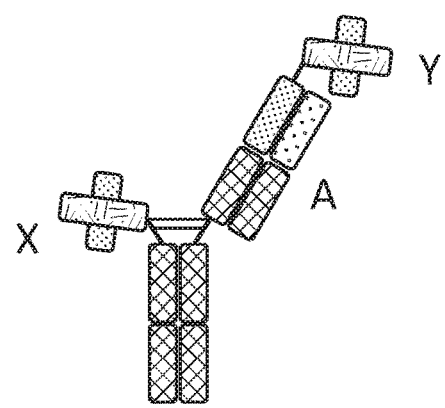
Figure 1M:
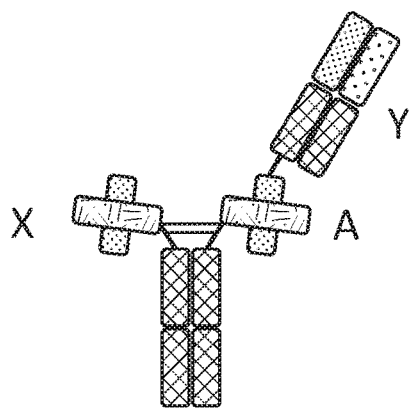
Figure 1N:
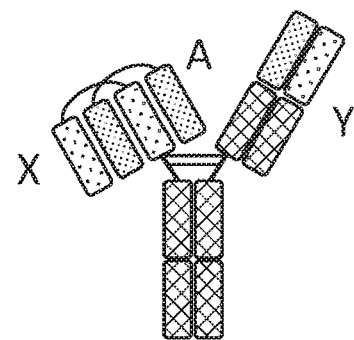
Figure 1O:
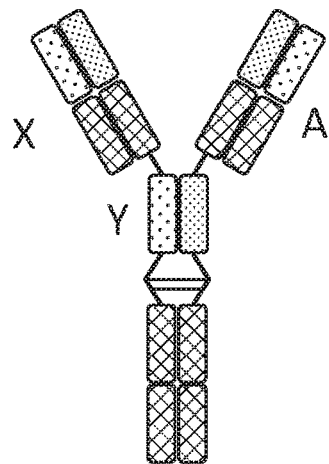
Figure 1P:
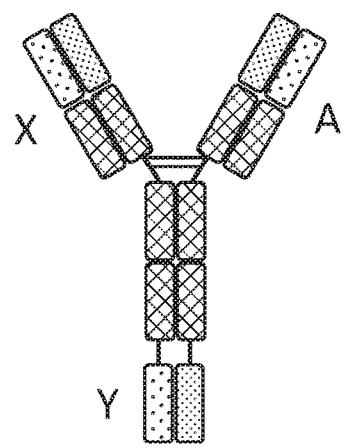
Figure 1W:
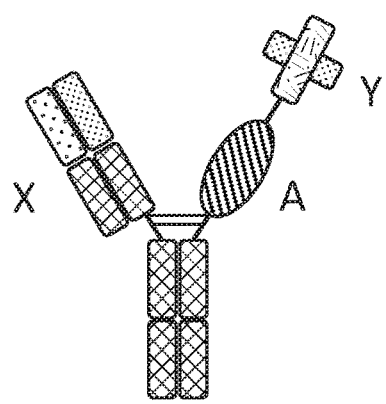
Figure 1X:
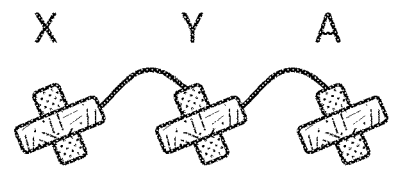
Figure 1Y:
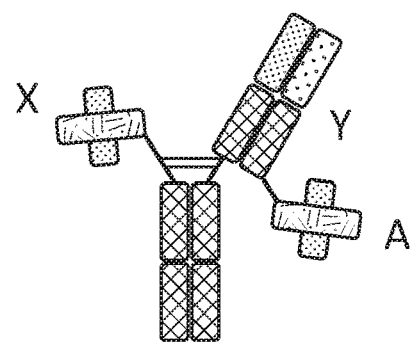
Figure 1Z:
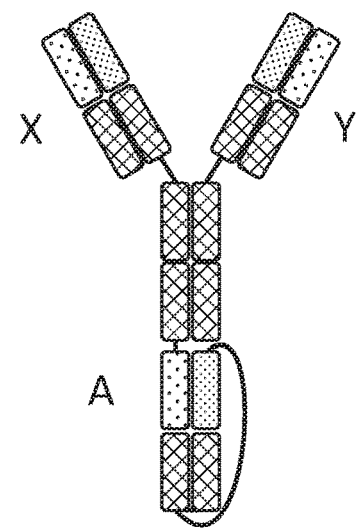
Figure 1A:
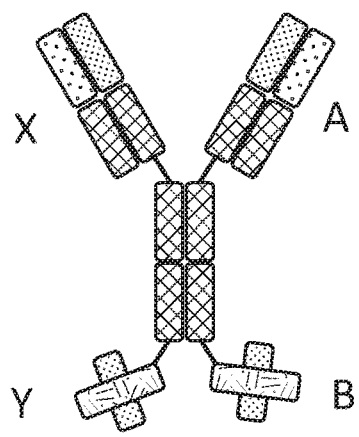
Figure 1A:
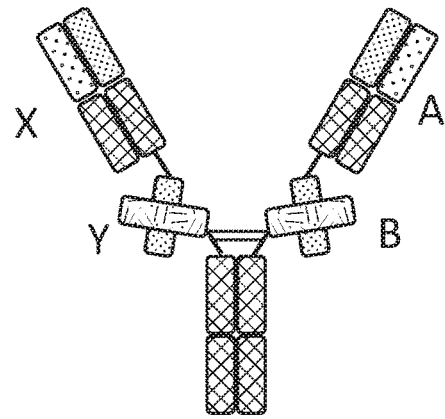
Figure 1A:
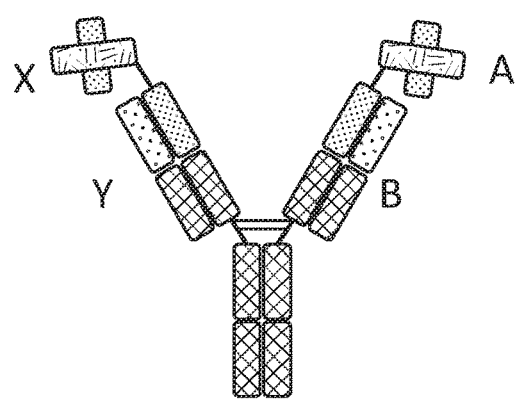
Figure 1A:
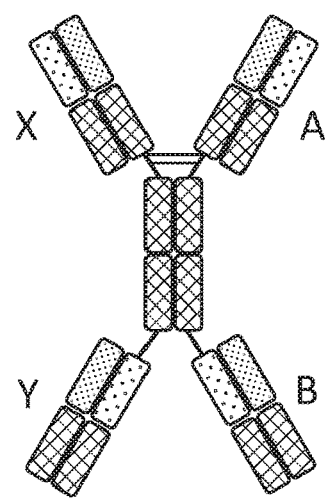
Figure 1A:
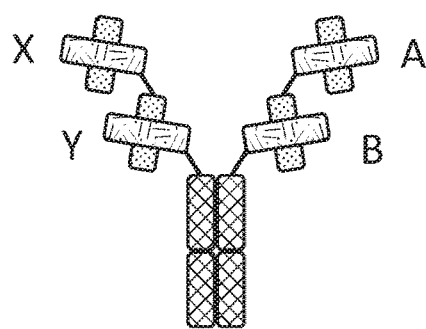
Figure 1A:
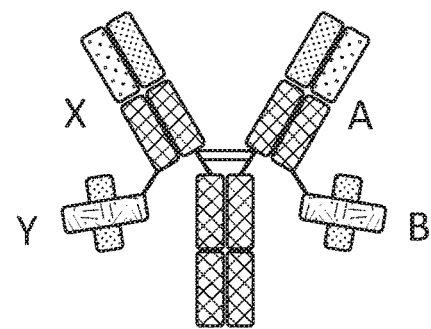
Figure 1A:
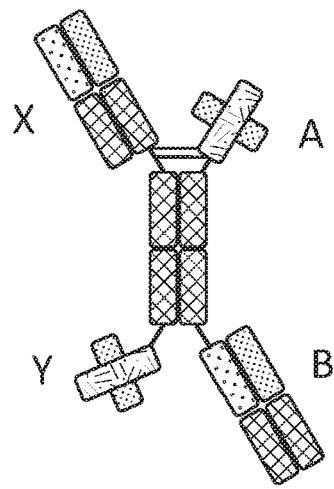
Figure 1A:
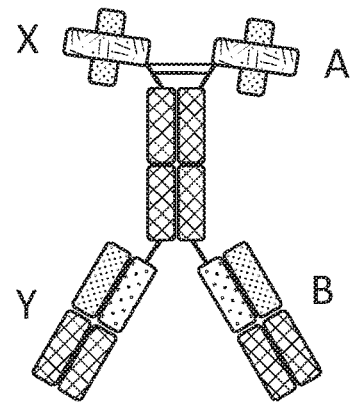

FIGS. 1A-1AH: Exemplary BBM configurations. FIG. 1A illustrates components of the exemplary BBM configurations illustrated in FIGS. 1B-1AH. Not all regions connecting the different domains of each chain are illustrated (e.g., the linker connecting the VH and VL domains of an scFv, the hinge connecting the CH2 and CH3 domains of an Fc domain, etc., are omitted). FIGS. 1B-1F illustrate bivalent BBMs; FIGS. 1G-1Z illustrate trivalent BBMs; FIGS. 1AA-1AH illustrate tetravalent BBMs. In the BBMs of the disclosure, a variant CD58 domain can substitute for a Fab and/or scFv in any of the configurations illustrated.

Figure 2A:
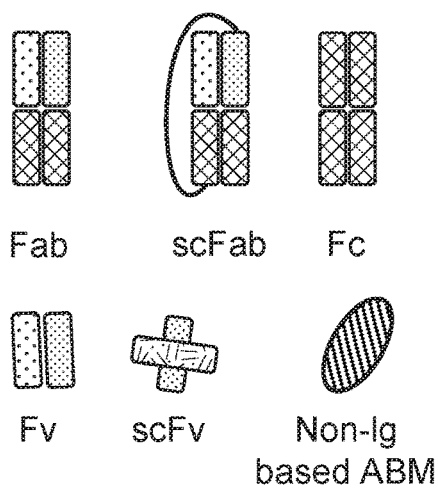
Figure 2B:
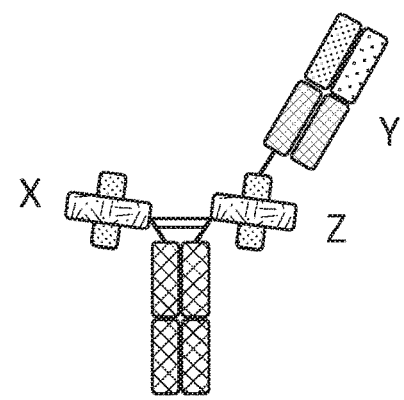
Figure 2C:
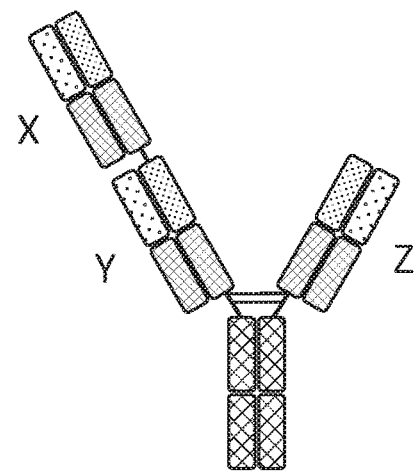
Figure 2D:
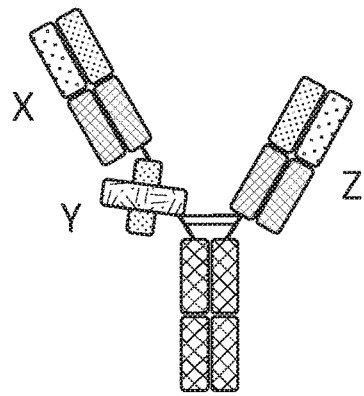
Figure 2E:
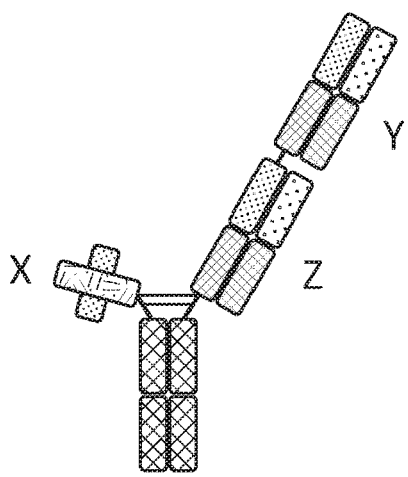
Figure 2F:
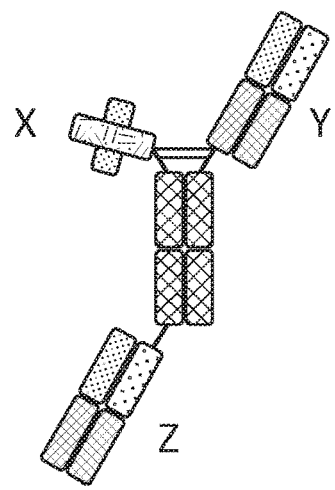
Figure 2G:
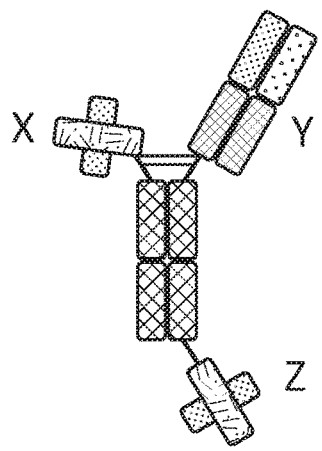
Figure 2H:
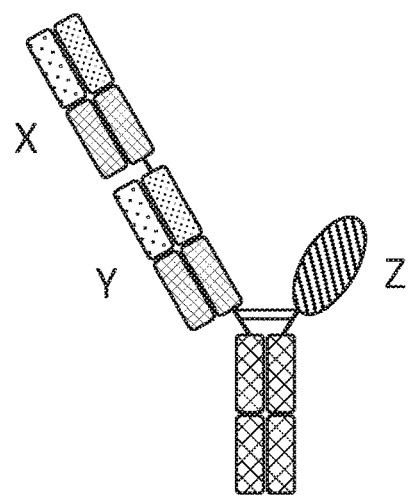
Figure 2I:
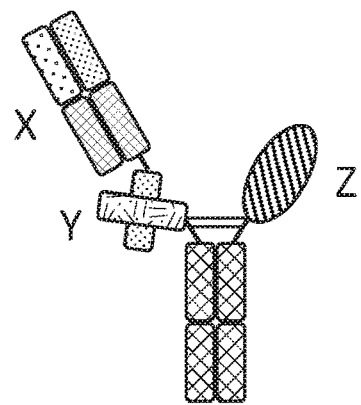
Figure 2J:
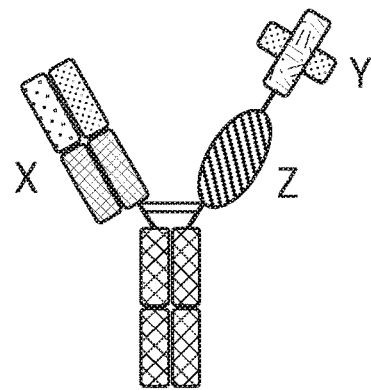
Figure 2K:
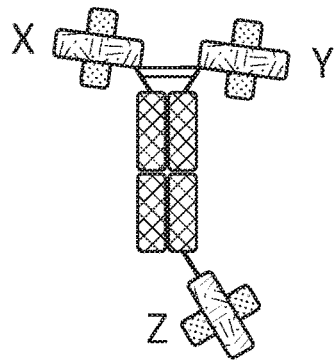
Figure 2L:
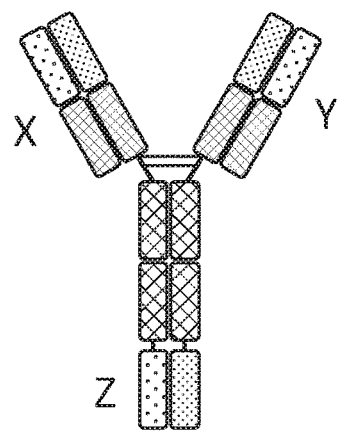
Figure 2M:
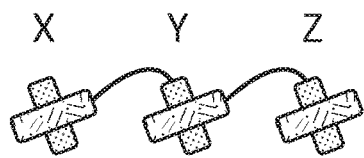
Figure 2N:
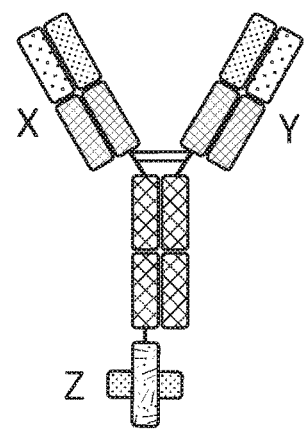
Figure 2O:
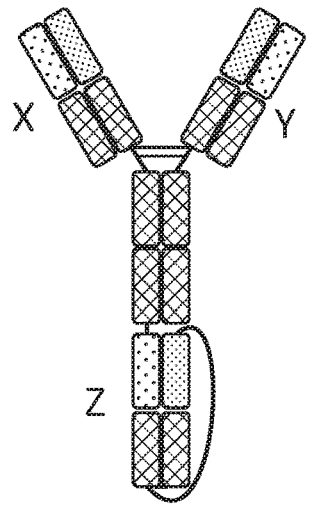
Figure 2P:
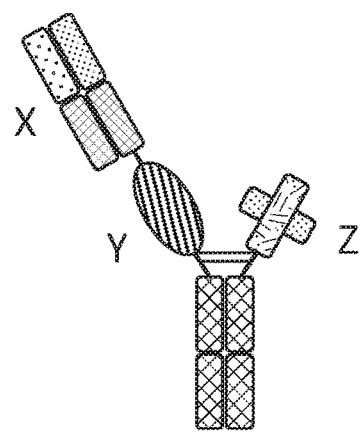
Figure 2Q:
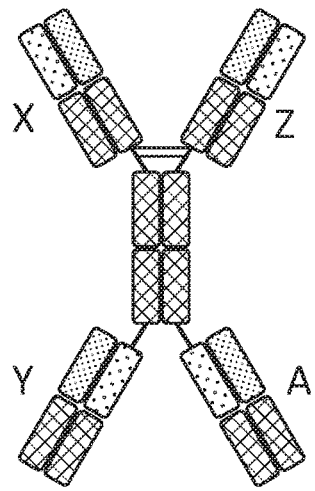
Figure 2R:
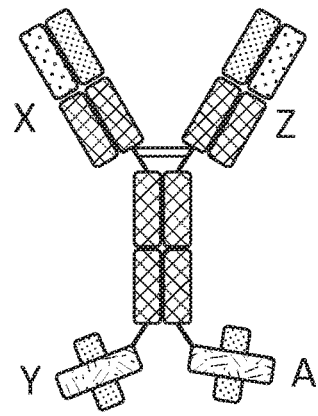
Figure 2S:
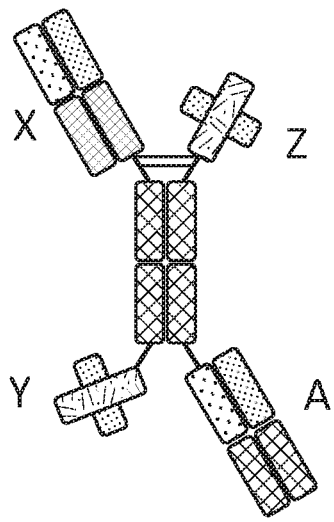
Figure 2T:
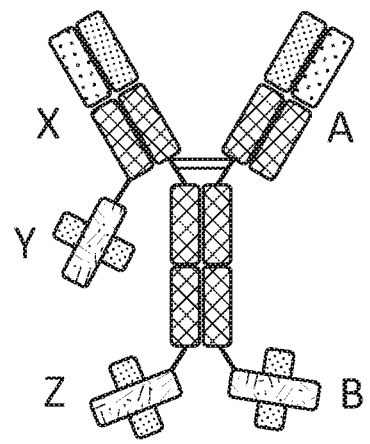
Figure 2U:
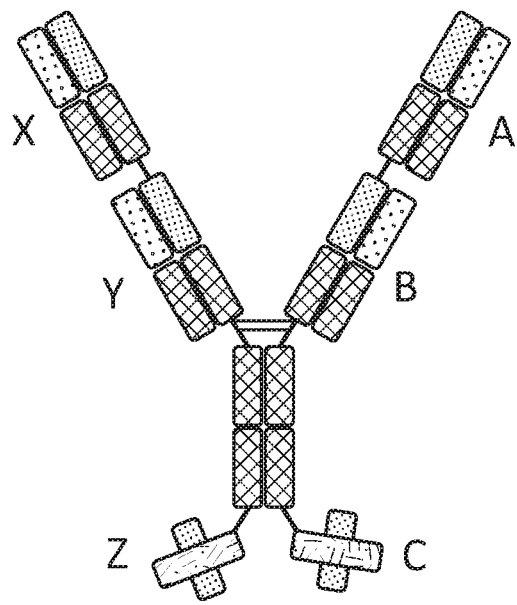
Figure 2V:
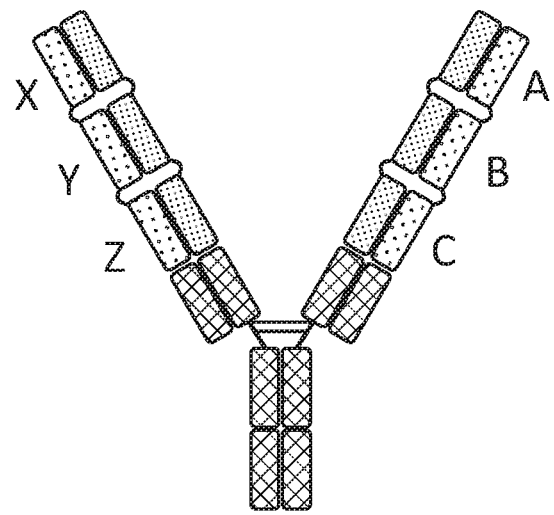

FIGS. 2A-2V: Exemplary TBM configurations. FIG. 2A illustrates components of the exemplary TBM configurations illustrated in FIGS. 2B-2V. Not all regions connecting the different domains of each chain are illustrated (e.g., the linker connecting the VH and VL domains of an scFv, the hinge connecting the CH2 and CH3 domains of an Fc, etc., are omitted). FIG. 2B-2P illustrates trivalent TBMs; FIGS. 2Q-2S illustrate tetravalent TBMs; FIG. 2T illustrates a pentavalent TBM, and FIGS. 2U-2V illustrate hexavalent TBMs. In the TBMs of the disclosure, a variant CD58 domain can substitute for a Fab and/or scFv in any of the configurations illustrated.

Figure 3A:
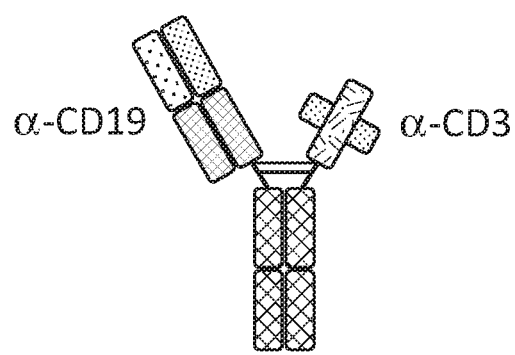
Figure 3B:
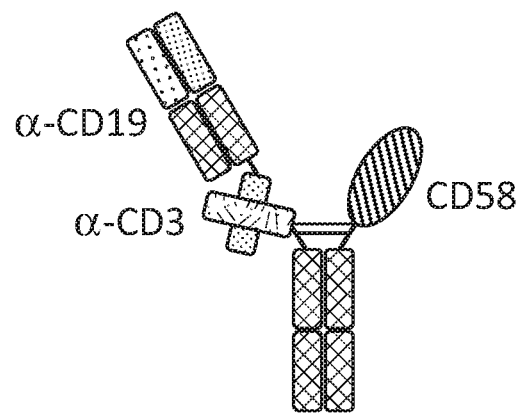

FIGS. 3A-3B: Schematics of the bispecific (FIG. 3A and FIG. 3C) and trispecific (FIG. 3B) constructs of Example 1.

Figure 4A:
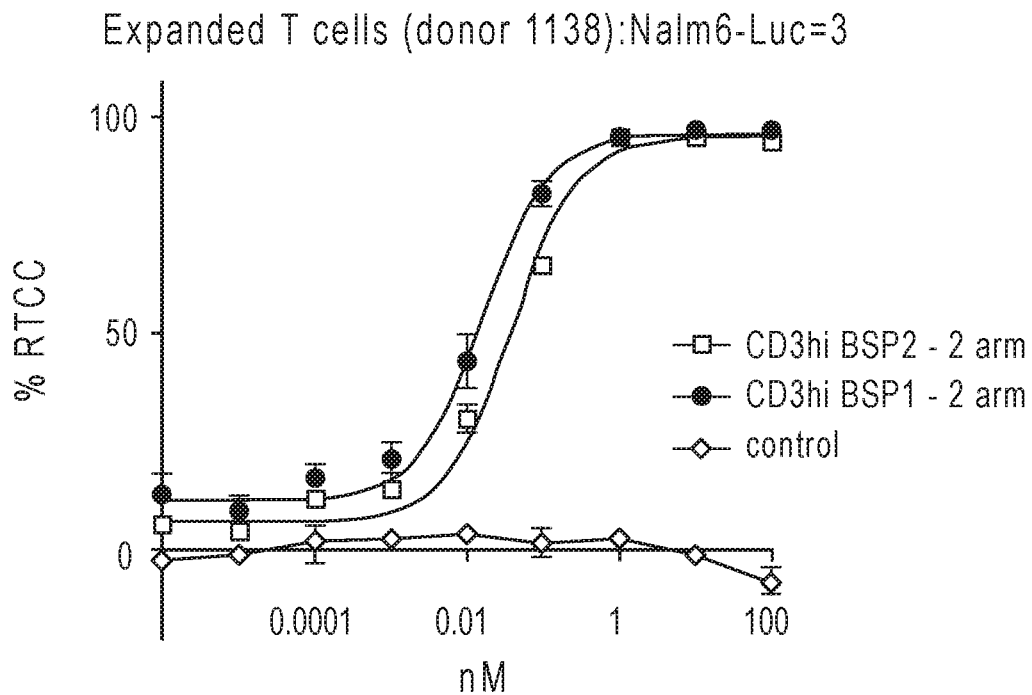
Figure 4B:
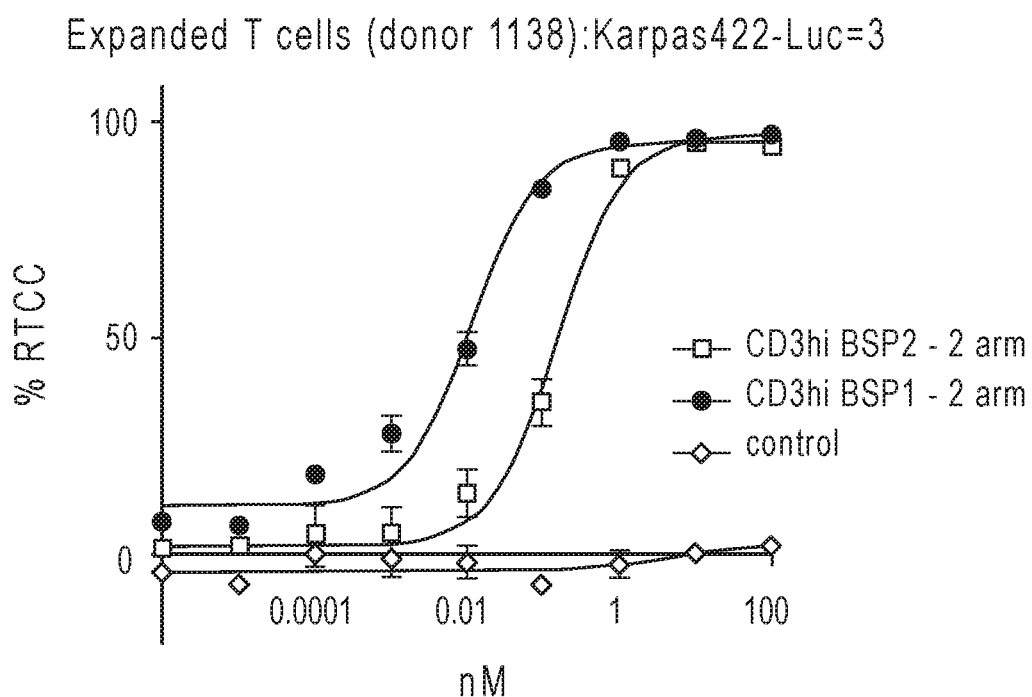

FIGS. 4A-4B: Ability of CD19 BBMs to elicit redirected T-cell cytotoxic activity (RTCC) against CD19+ target cells. Both NEG258-based and NEG218-based BBMs mediated RTCC activity against CD19+ target cell lines. Nalm6-luc (FIG. 4A) and Karpas422-luc (FIG. 4B) cells were co-cultured with expanded T cells in the presence of serial diluted BBMs at an effector cell: target cell (E:T) ratio of 3:1. Luminescence signal was measured after 24 h of incubation.

Figure 5A:
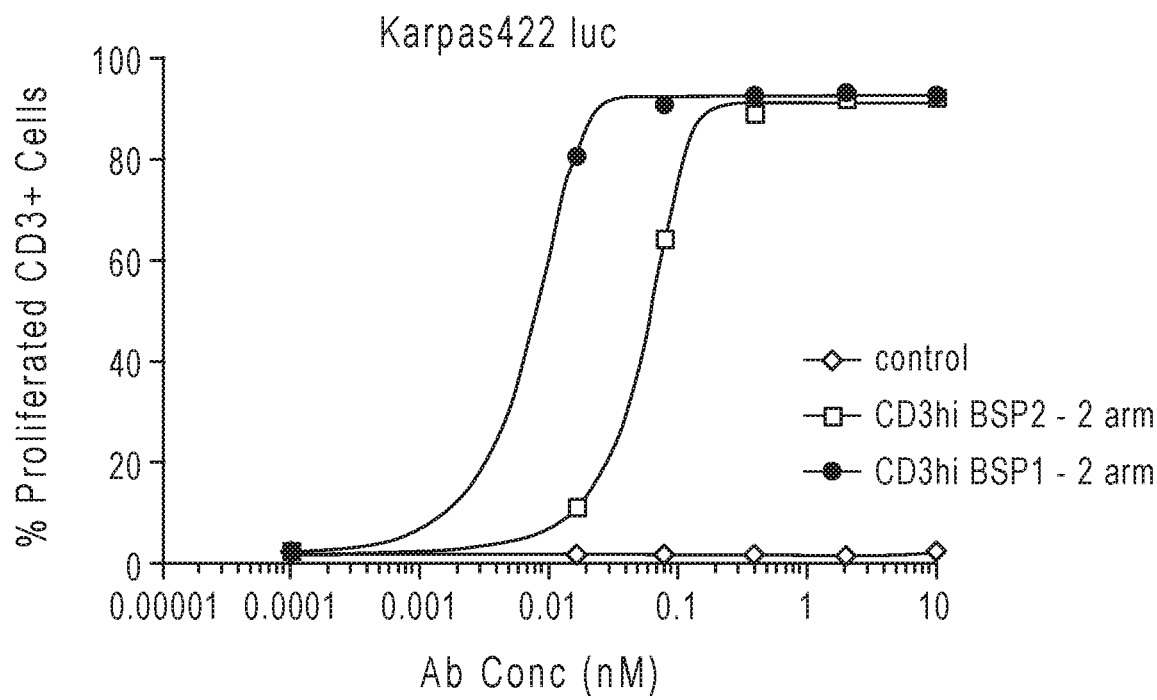
Figure 5B:
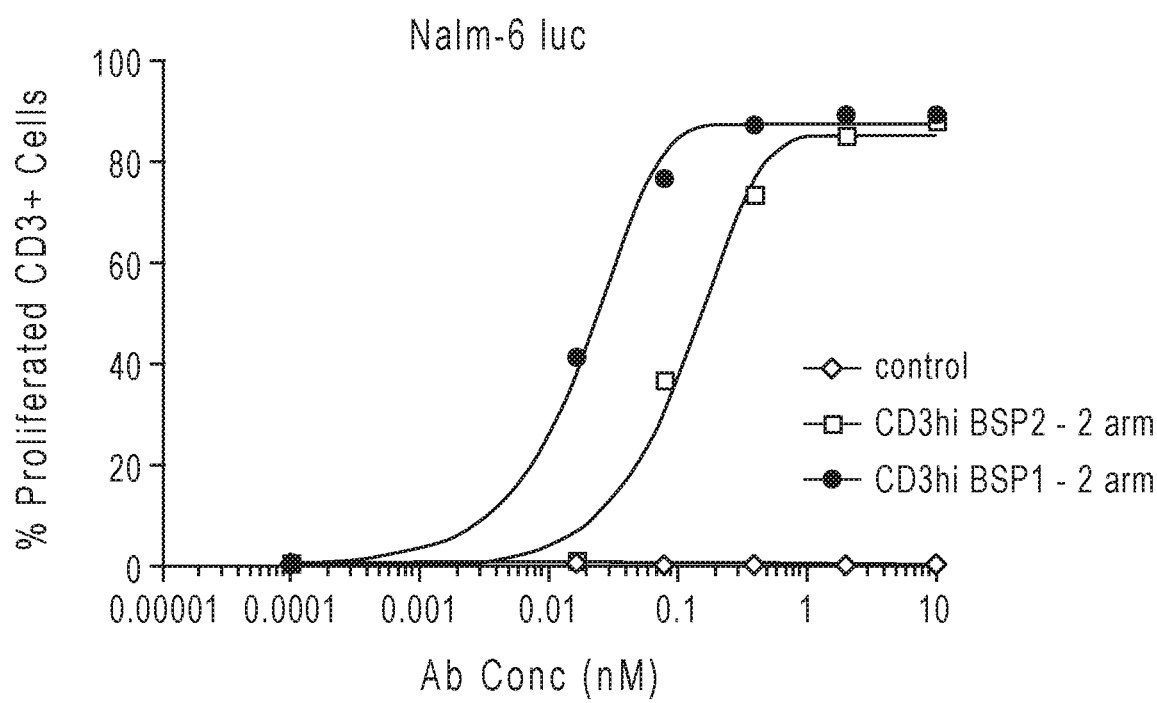

FIGS. 5A-5B: Ability of CD19 BBMs to elicit T-cell proliferation. Both NEG258-based and NEG218-based BBMs induced T cell proliferation. Karpas422-luc (FIG. 5A) and Nalm6-luc (FIG. 5B) cells were co-cultured with expanded T cells in the presence of serial diluted BBMs at an E:T ratio of 1:1. Luminescence signal was measured after 96 h of incubation.

Figure 6A:
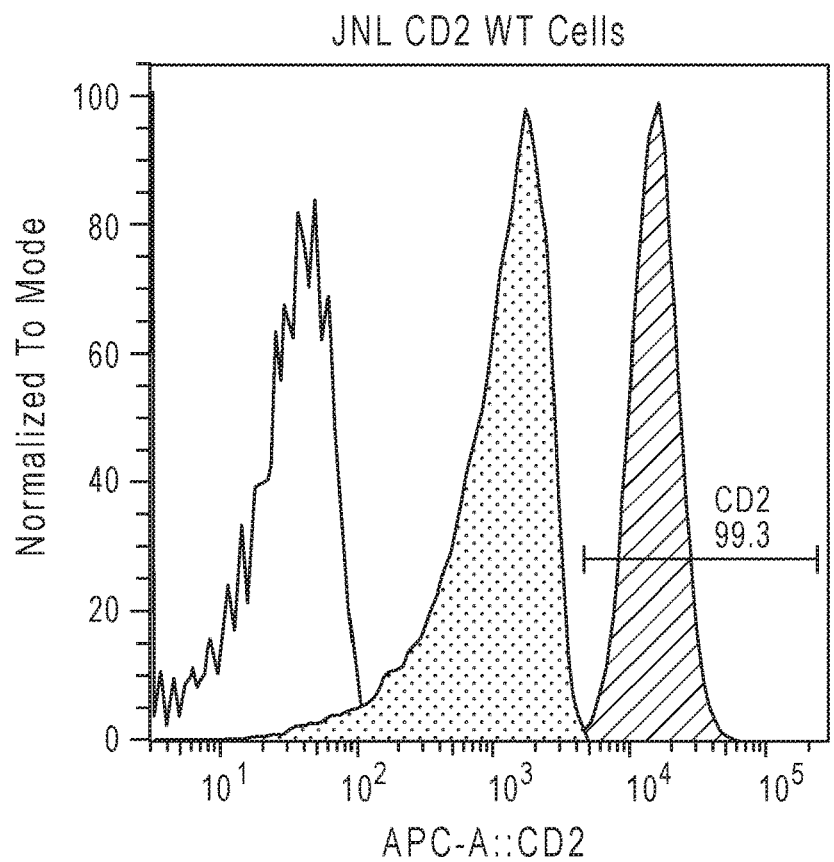
Figure 6B:
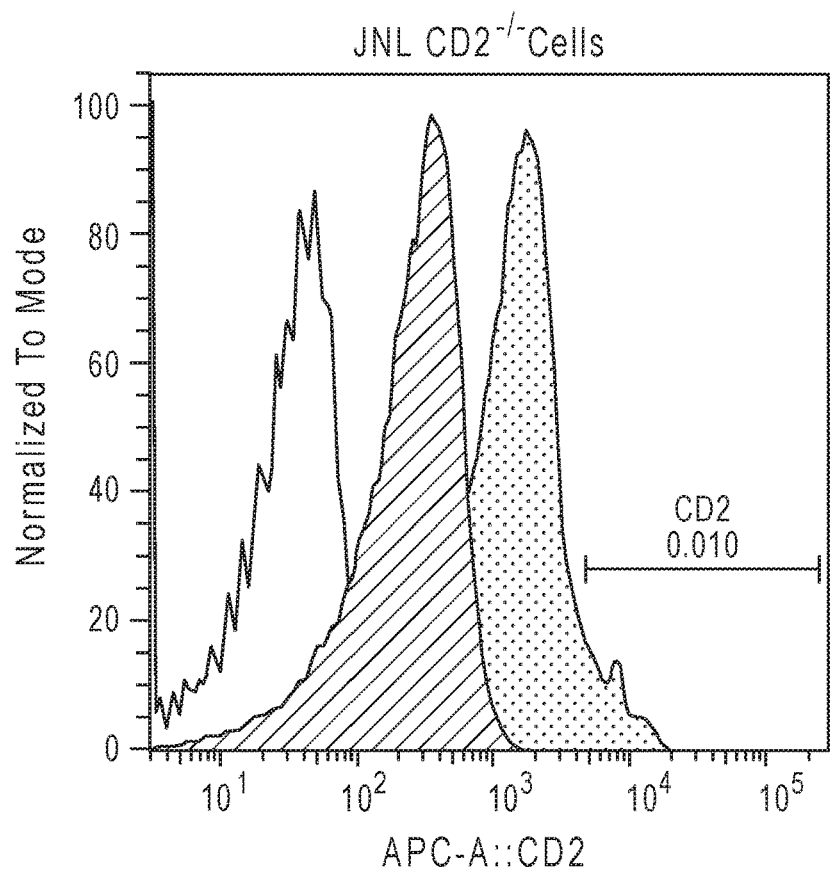
Figure 6C:
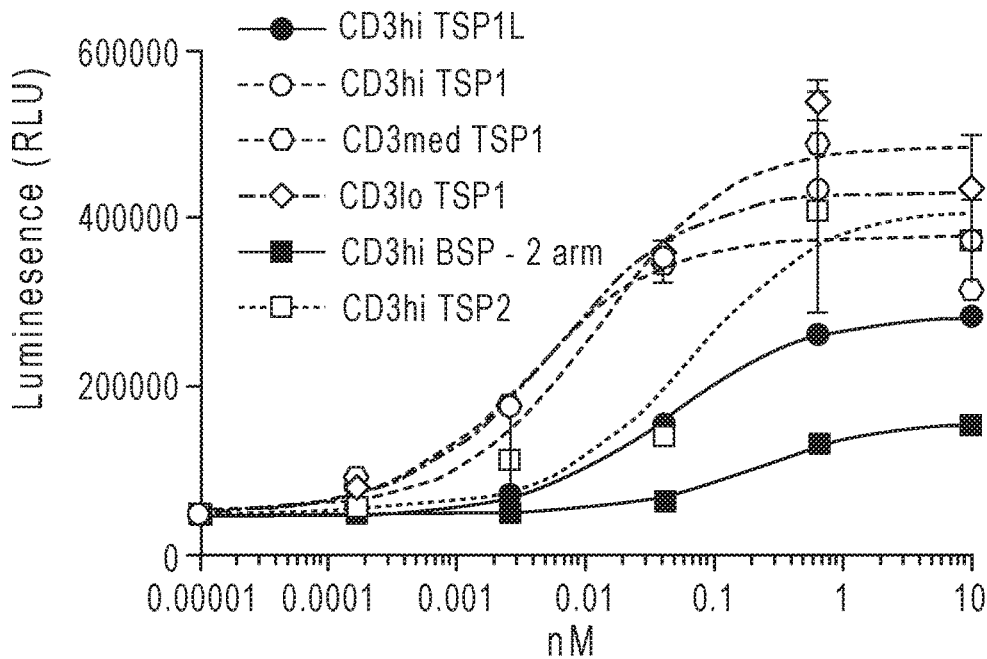
Figure 6D:
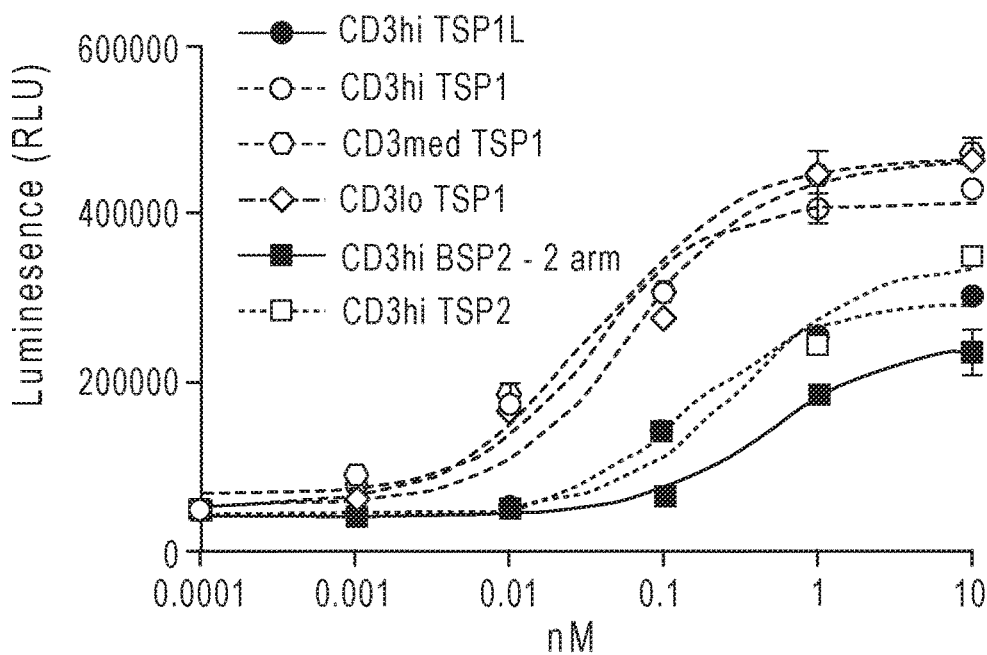
Figure 6E:
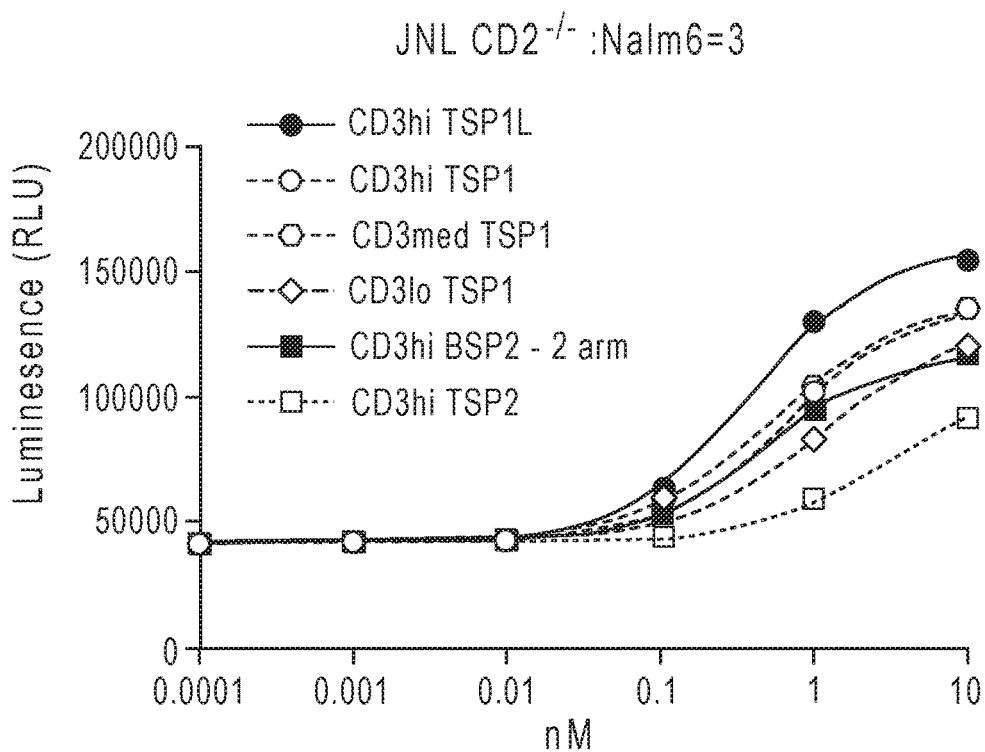
Figure 6F:
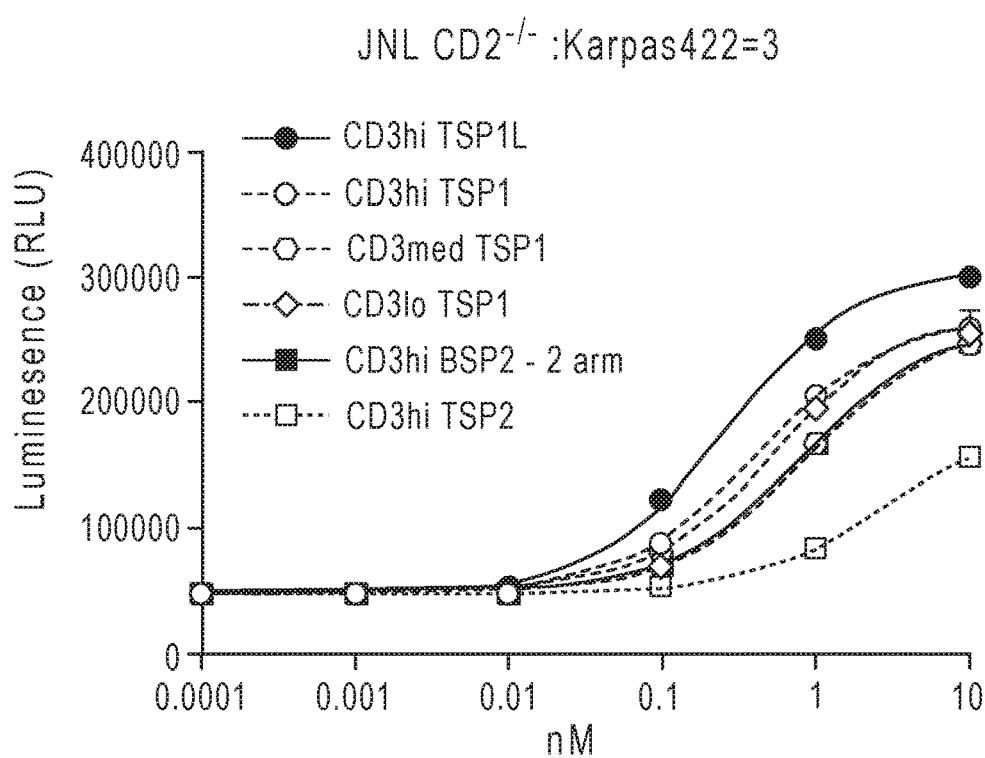

FIGS. 6A-6F: Ability of CD19 TBMs to elicit CD2 dependent T cell activation. CD2 knock out attenuated advantage of trispecific constructs. FIGS. 6A-6B show representative flow cytometry analysis of CD2 expression on JNL CD2 WT (FIG. 6A) and KO (FIG. 6B) cells. Staining by the anti-CD2 mAb (dot filled histogram) is overlaid with that of the mIgG1 isotype control (diagonal line filled histogram) or unstained (open histogram). FIGS. 6C-6F show data for JNL CD2$^+$ (FIG. 6C-6D) and CD2$^-$ (FIG. 6E-6F) cells co-cultured with CD19+ target cells in the presence of serial diluted BBMs and TBMs at an E:T ratio of 3:1. Luminescence signal was measured after 24 h of incubation.

Figure 7A:
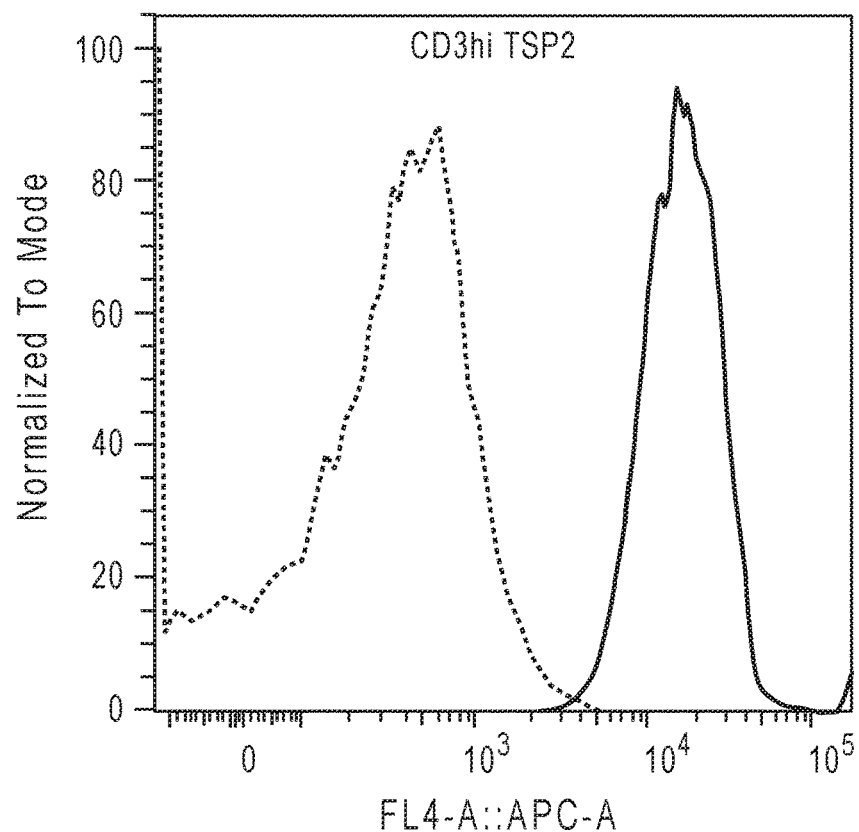
Figure 7B:
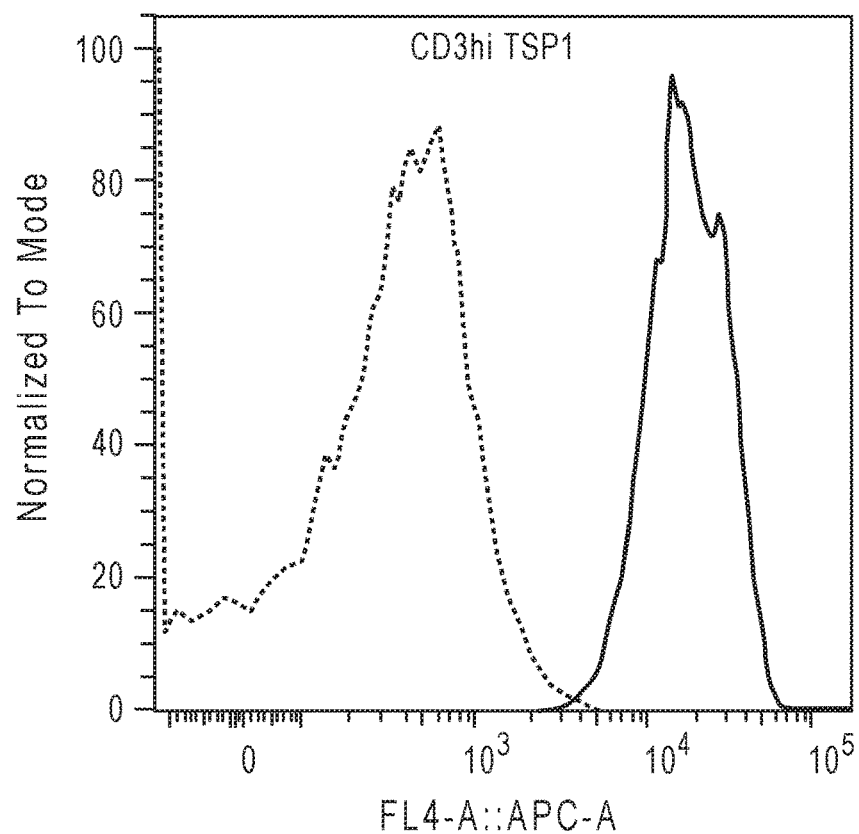

FIGS. 7A-7B: Binding of CD19 TBMs to cyno B cells. FIG. 7A shows data for a TBM with a NEG218-based CD19 binding arm and FIG. 7B shows data for a TBM with a NEG-258-based CD19 binding arm.

Figure 8A:
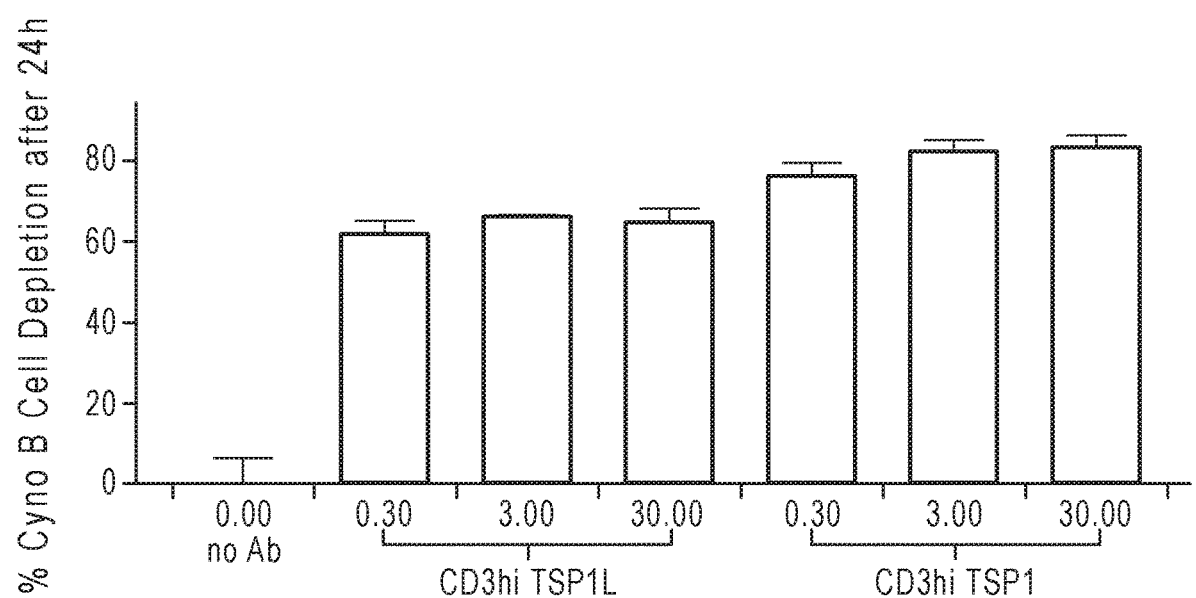
Figure 8B:
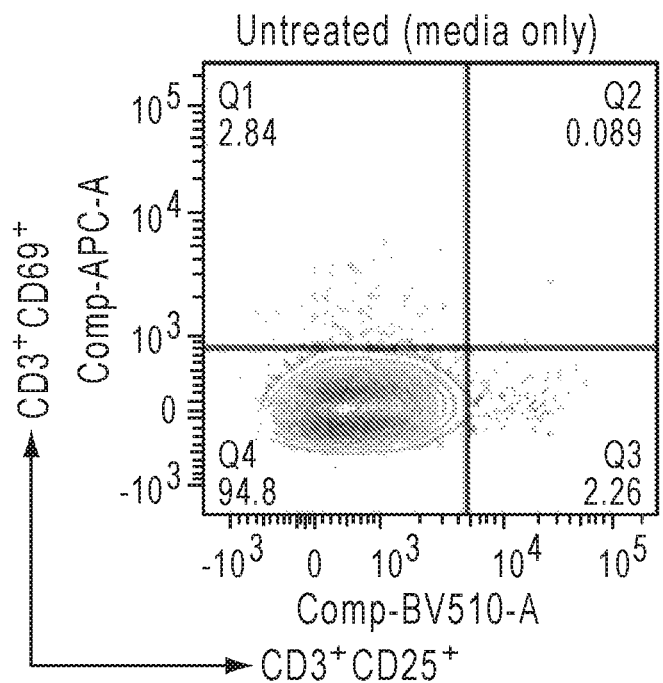
Figure 8C:
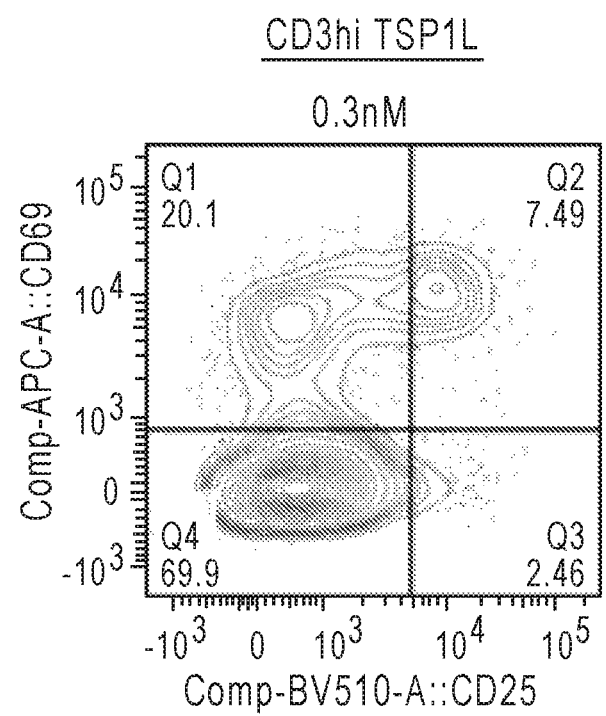
Figure 8D:
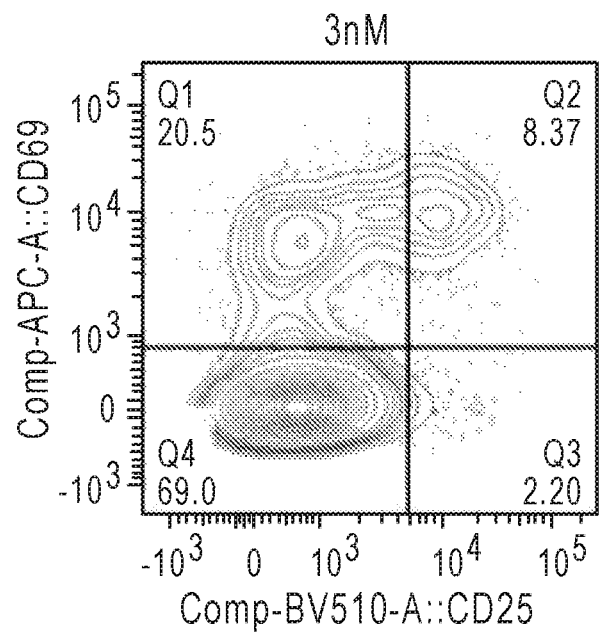
Figure 8E:
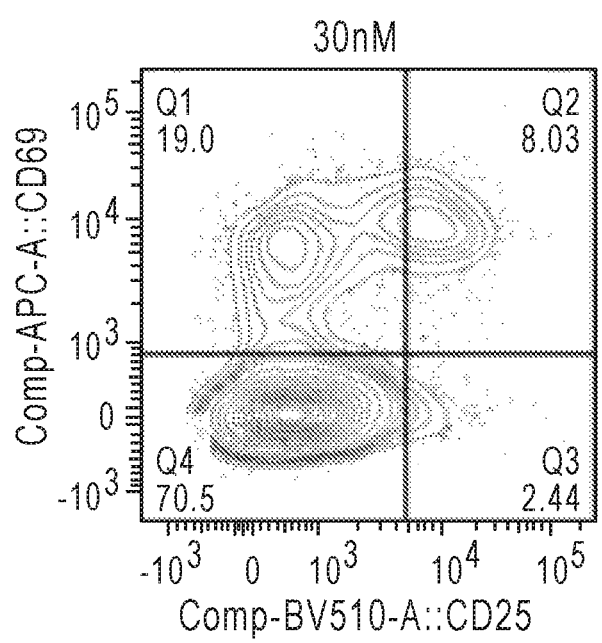

FIGS. 8A-8H: Ability of CD19 TBMs to induce T cell activation upon cyno B cell depletion in PBMCs. In FIG. 8A, PBMCs were isolated from cyno monkey whole blood using ficoll gradient centrifugation and were incubated with bi or trispecific constructs for overnight. Samples were harvested and simultaneously stained for CD3 and CD20 to identify B and T cells within the PBMC population. Percentage of B cell depletion was calculated as described in Section 8.6.1. FIGS. 8B-8H show the results of FACS analysis of CD69 and CD25 expression on CD3$^+$ T cells to determine single (CD69$^+$ CD25$^-$ or CD69$^-$CD25$^+$) or double-positive cells (CD69$^+$CD25$^+$). FIG. 8B: untreated (media only); FIGS. 8C-8E: CD3hi TSP1L; FIGS. 8F-8H: CD3hi TSP1.

Figure 9A:
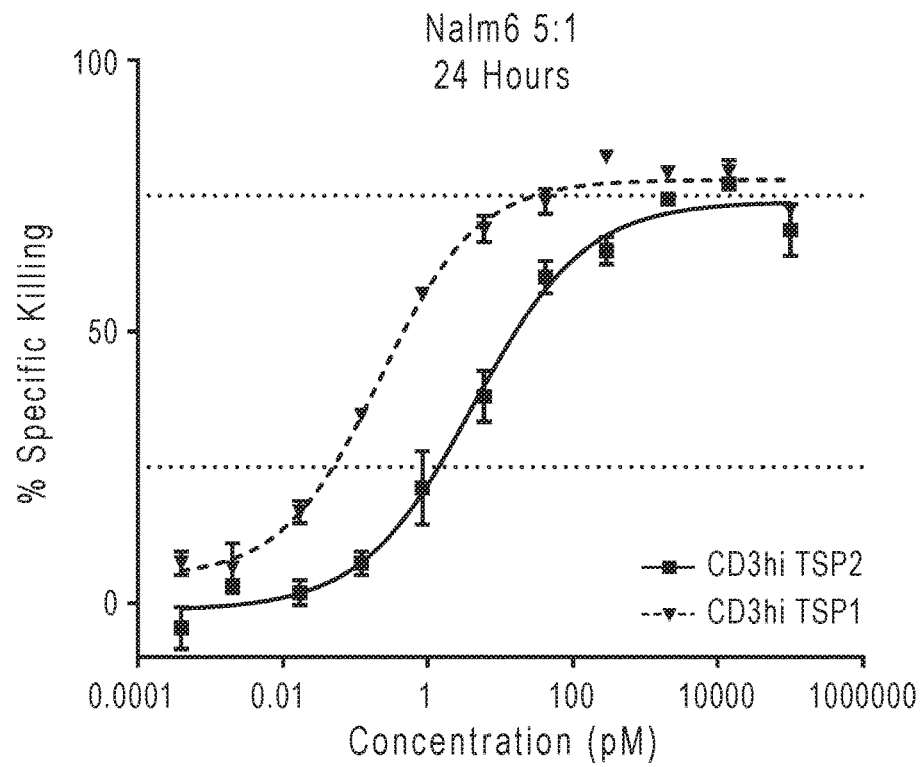
Figure 9B:
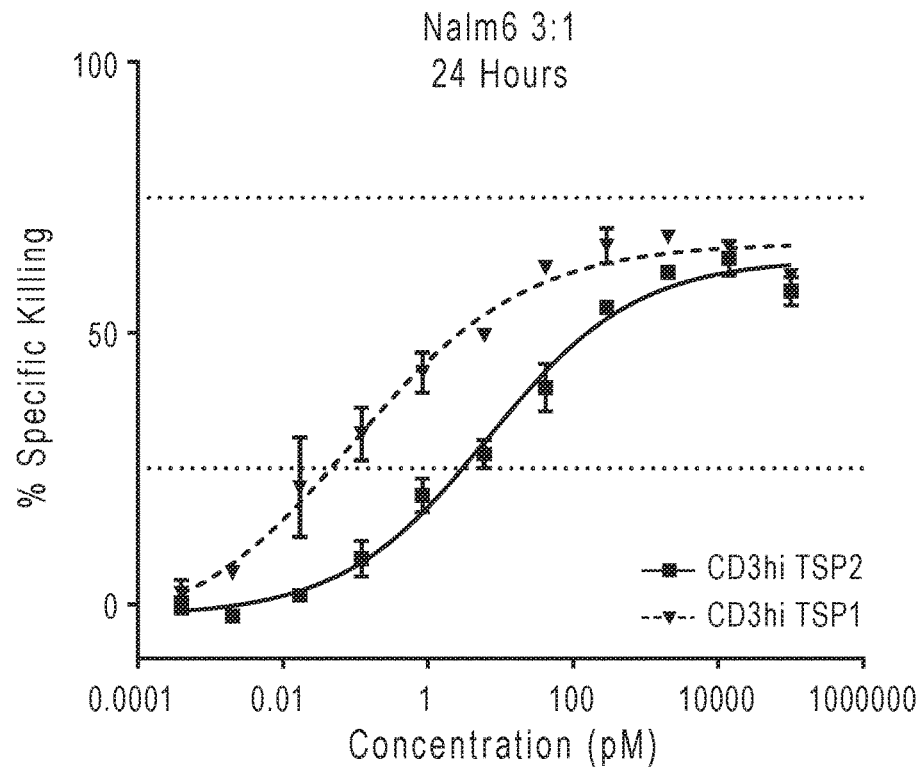
Figure 9C:
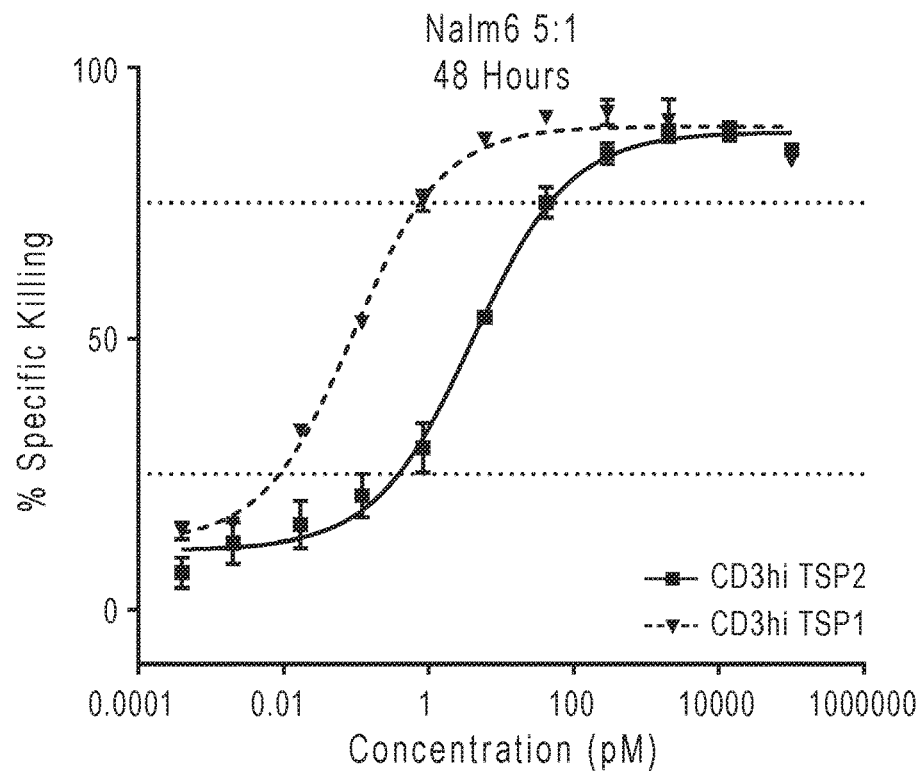
Figure 9D:
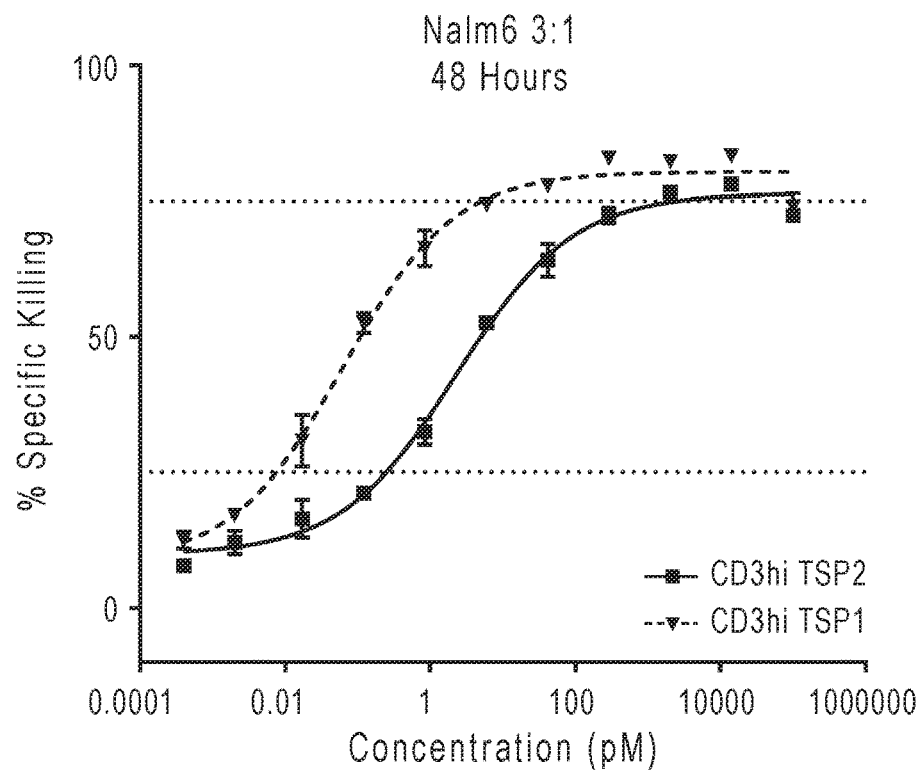
Figure 9E:
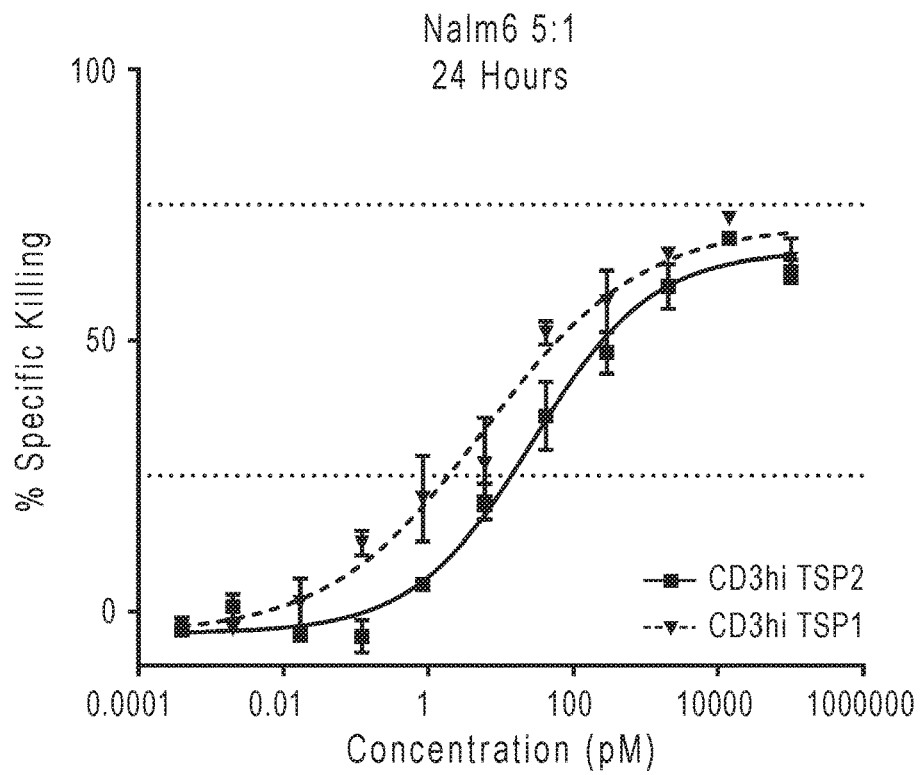
Figure 9F:
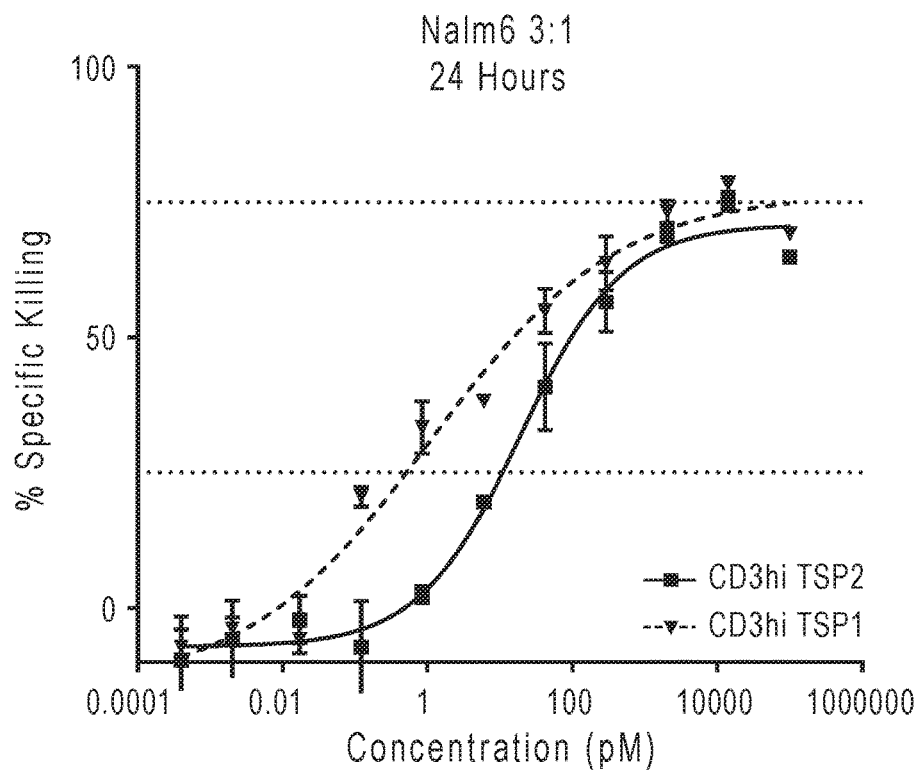
Figure 9G:
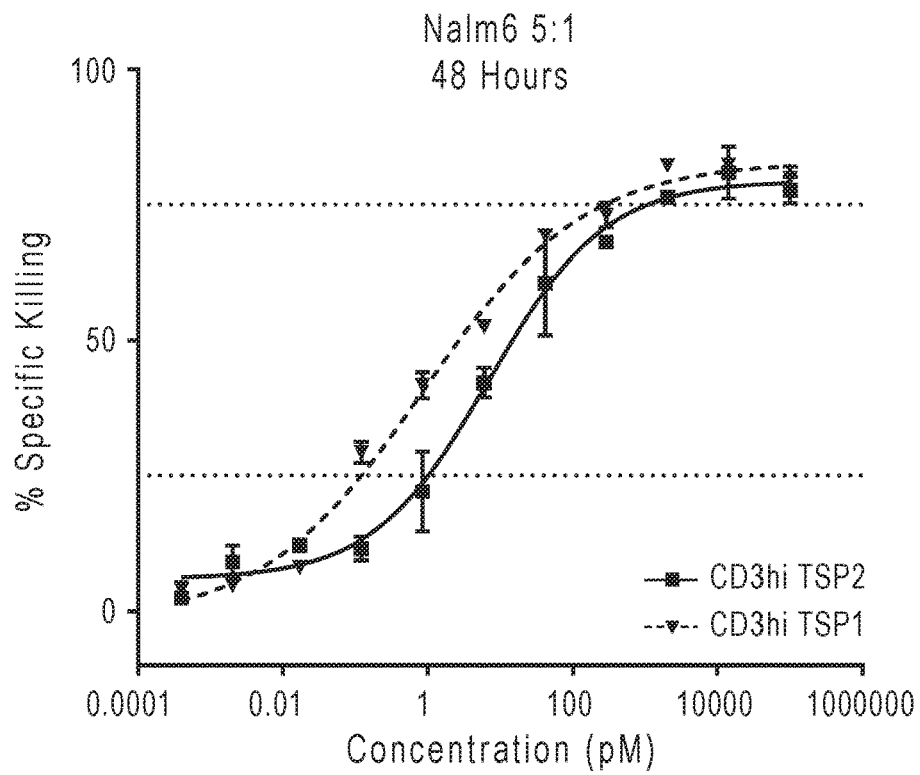
Figure 9H:
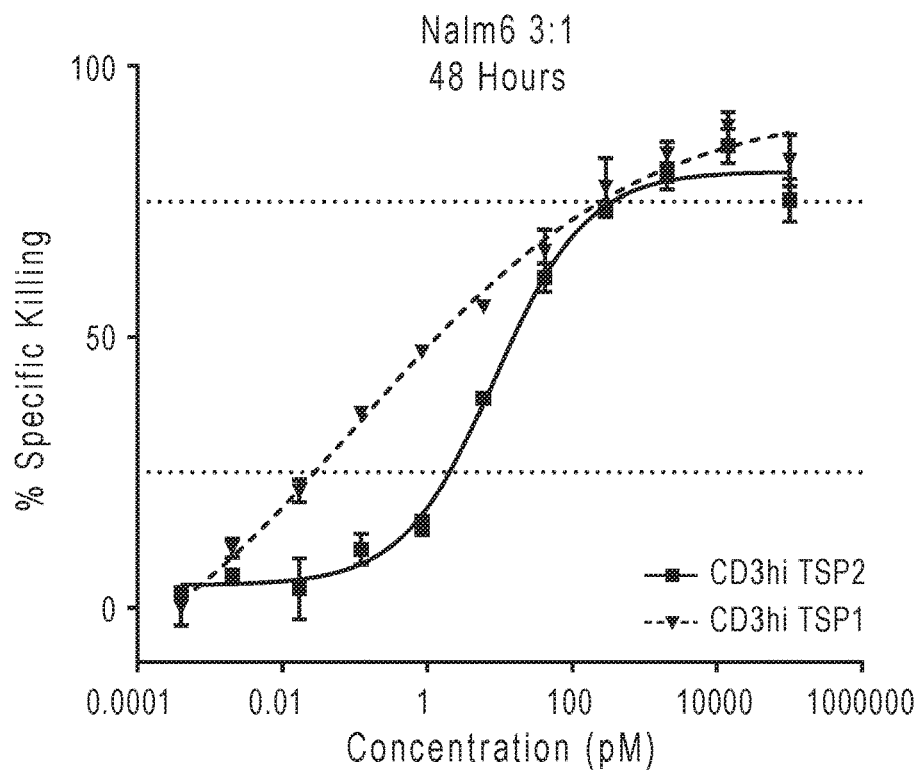
Figure 9I:
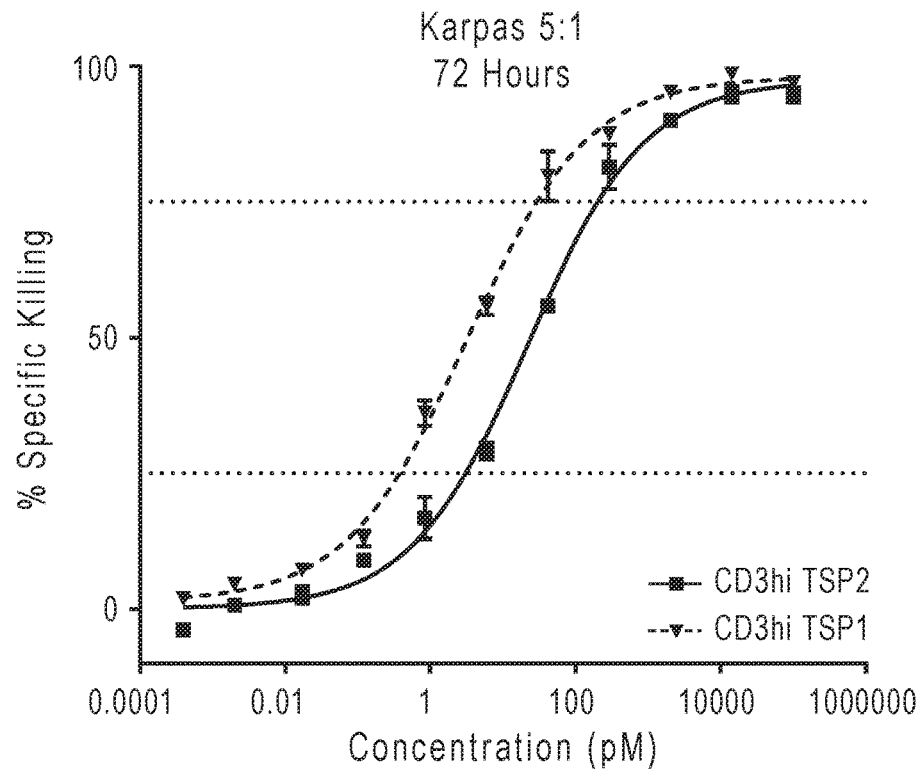
Figure 9J:
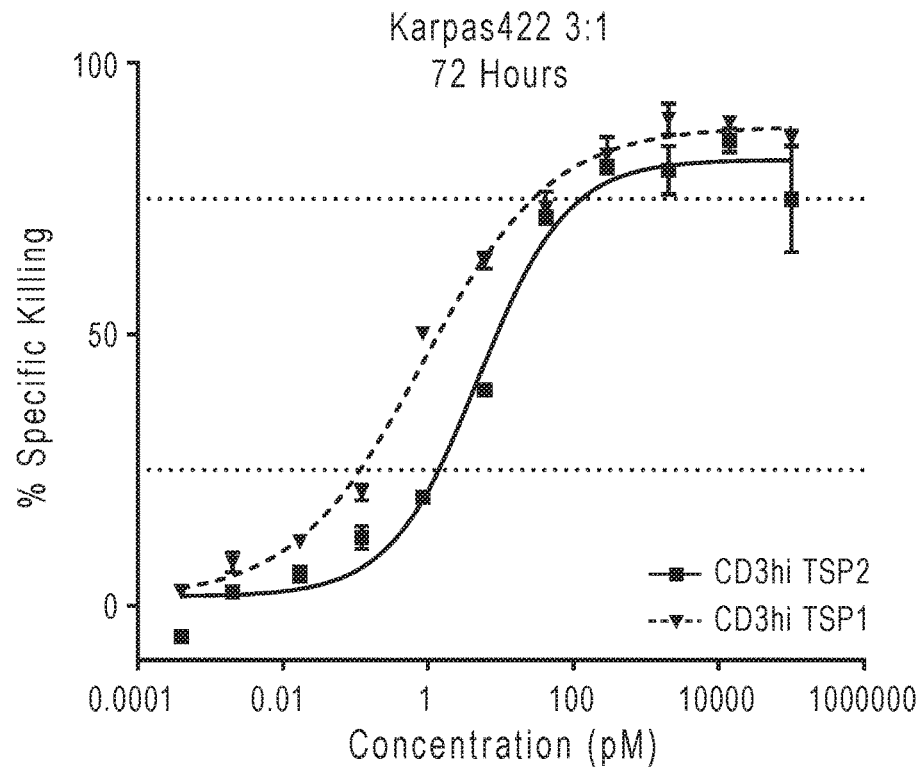
Figure 9K:
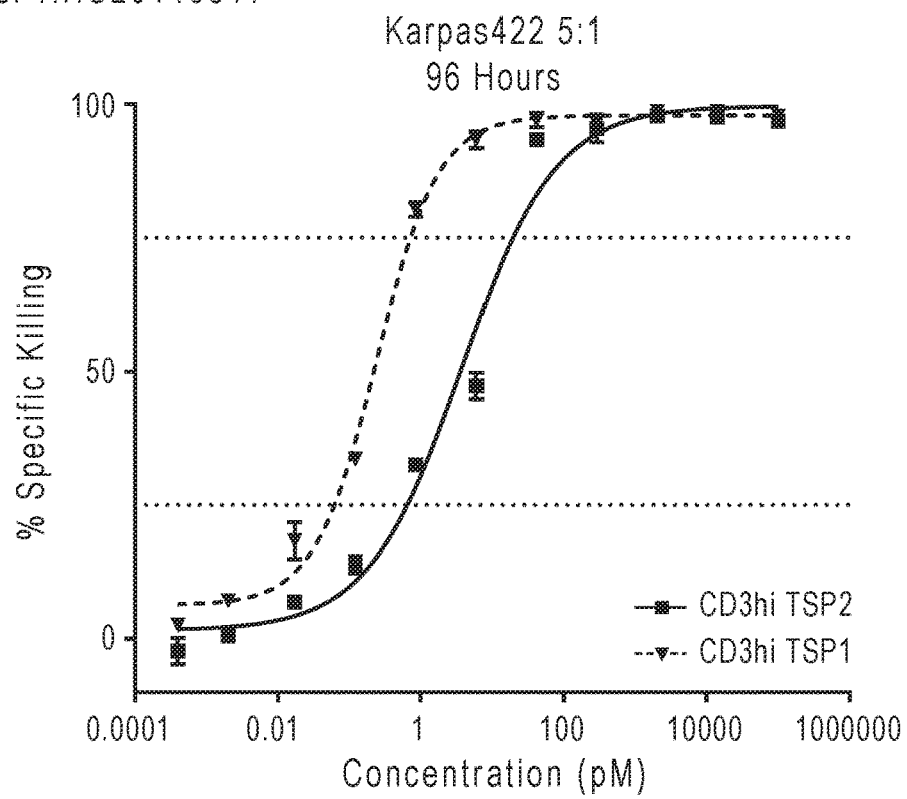
Figure 9L:
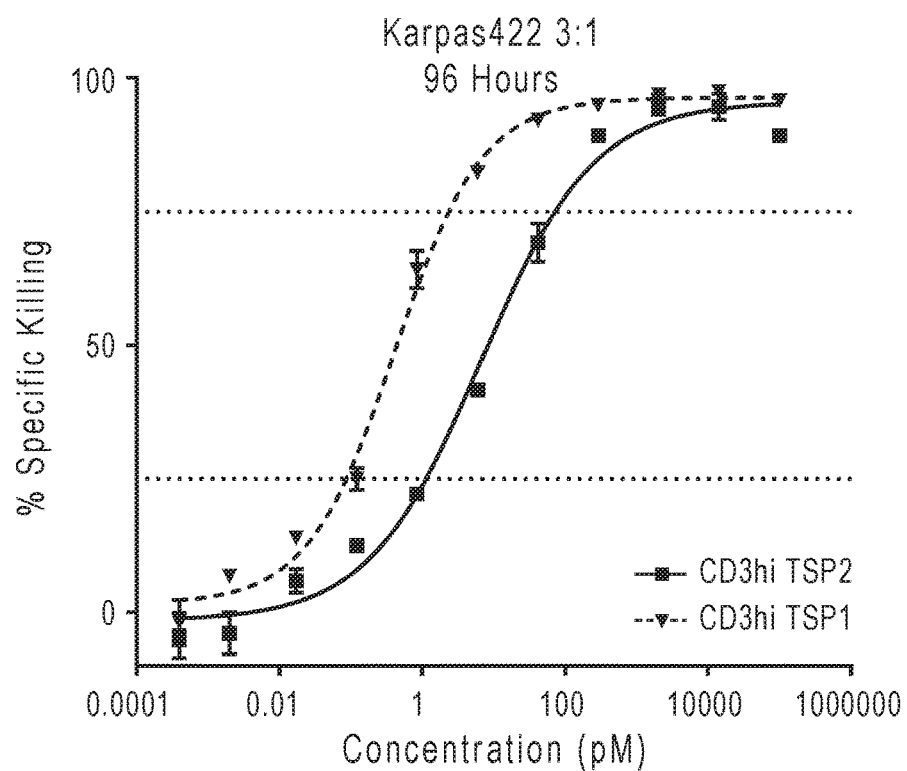
Figure 9M:
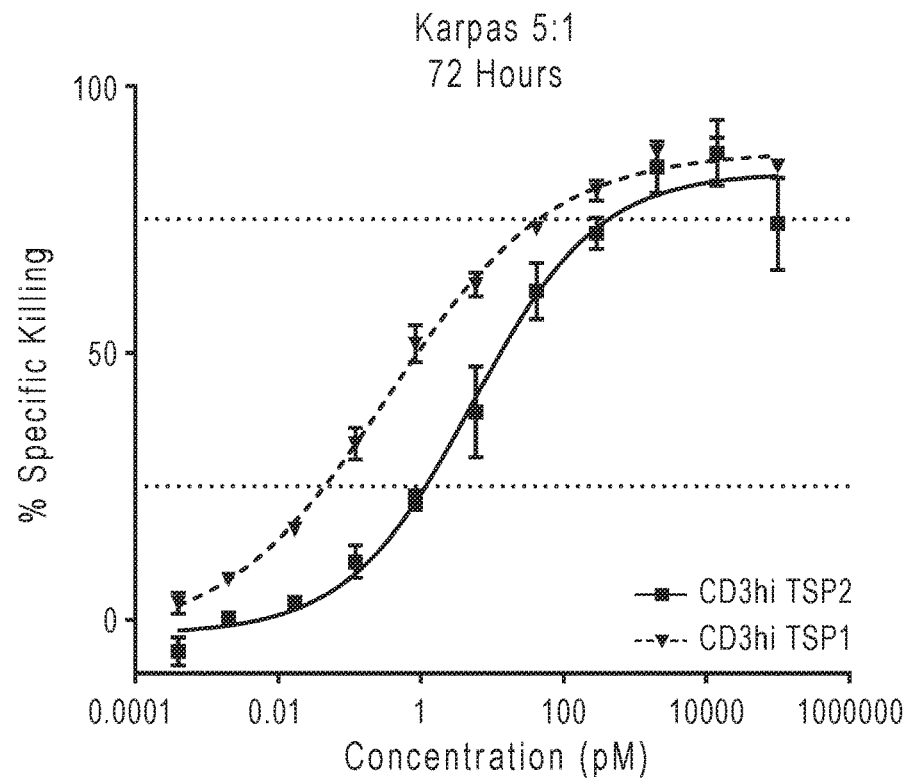
Figure 9N:
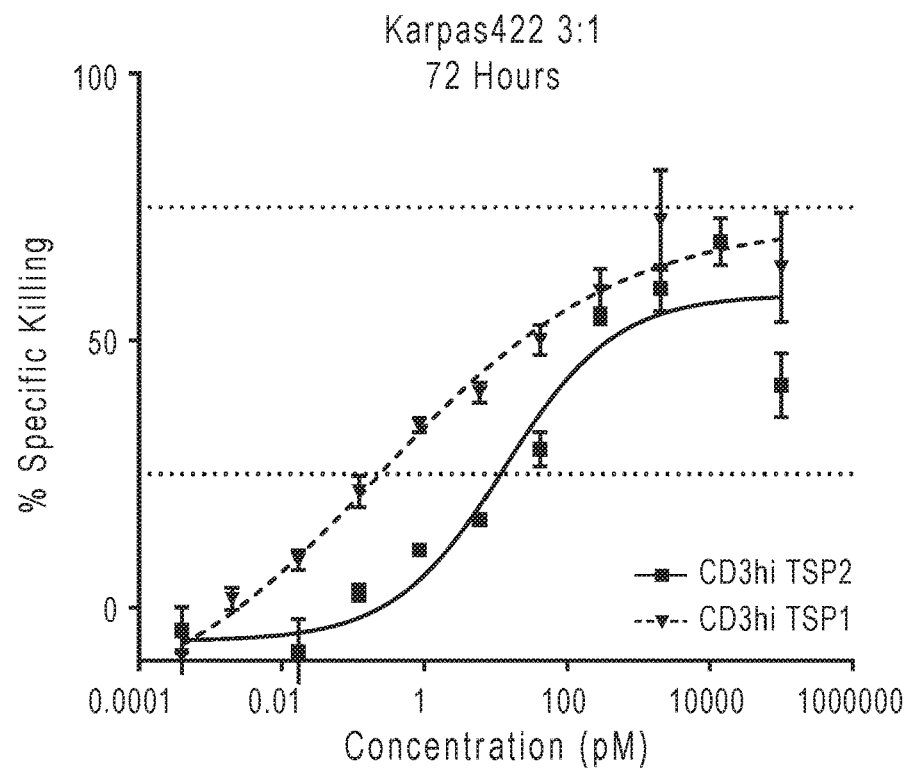
Figure 9O:
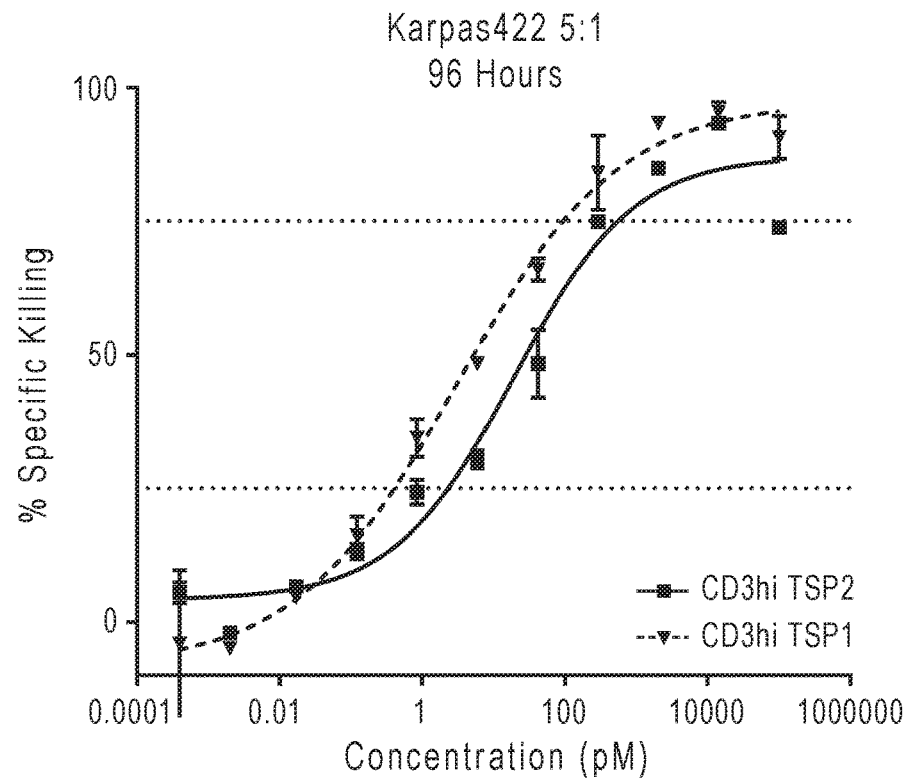
Figure 9P:
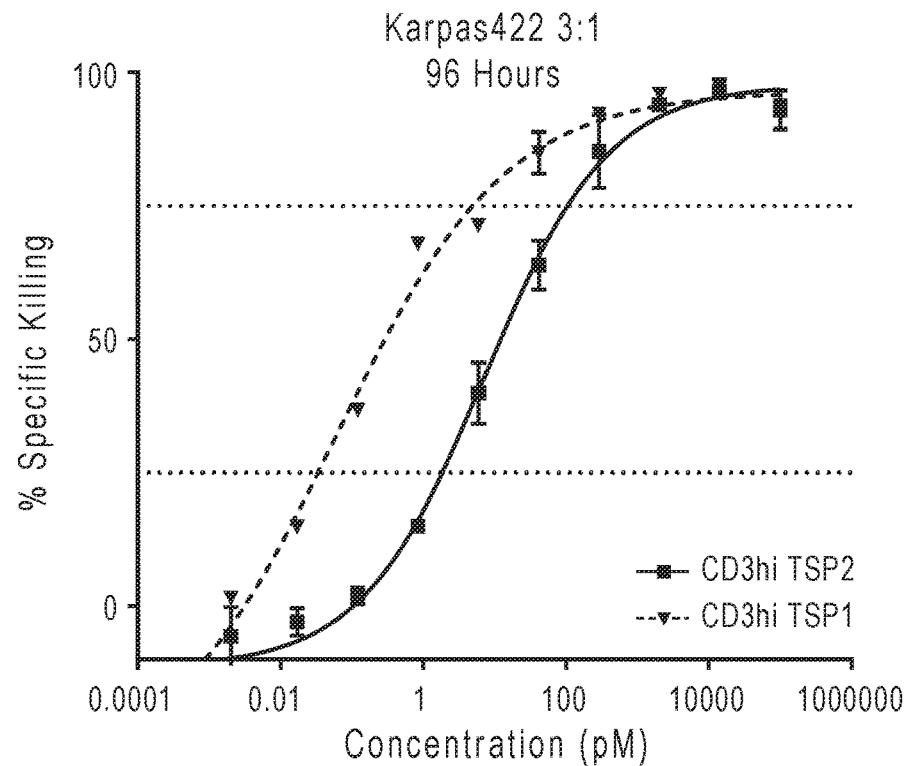

FIGS. 9A-9P: Ability of NEG258- and NEG218-based TBMs to induce redirected T cell cytotoxicity by human donor cells against Nalm6 (FIGS. 9A-9H) and Karpas422 (FIGS. 9I-9P) target cells.

Figure 10A:
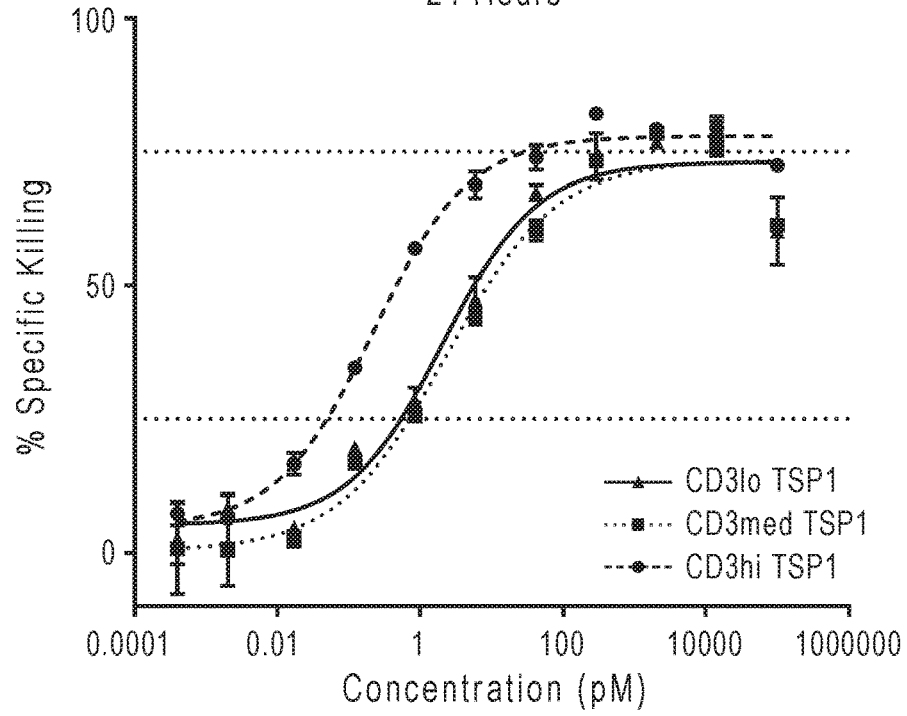
Figure 10B:
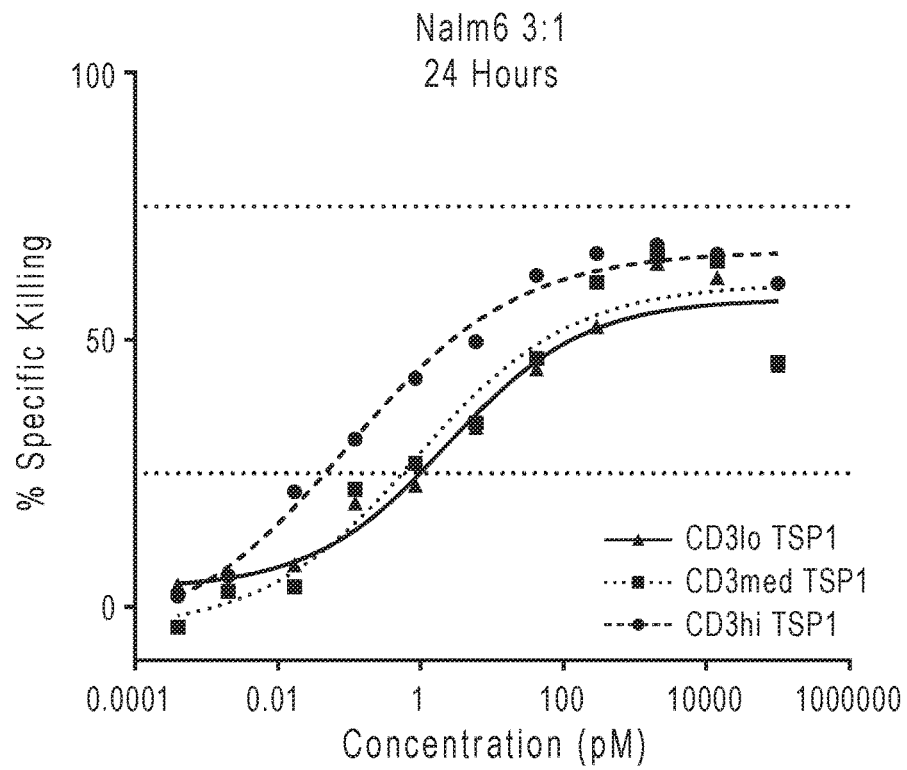
Figure 10C:
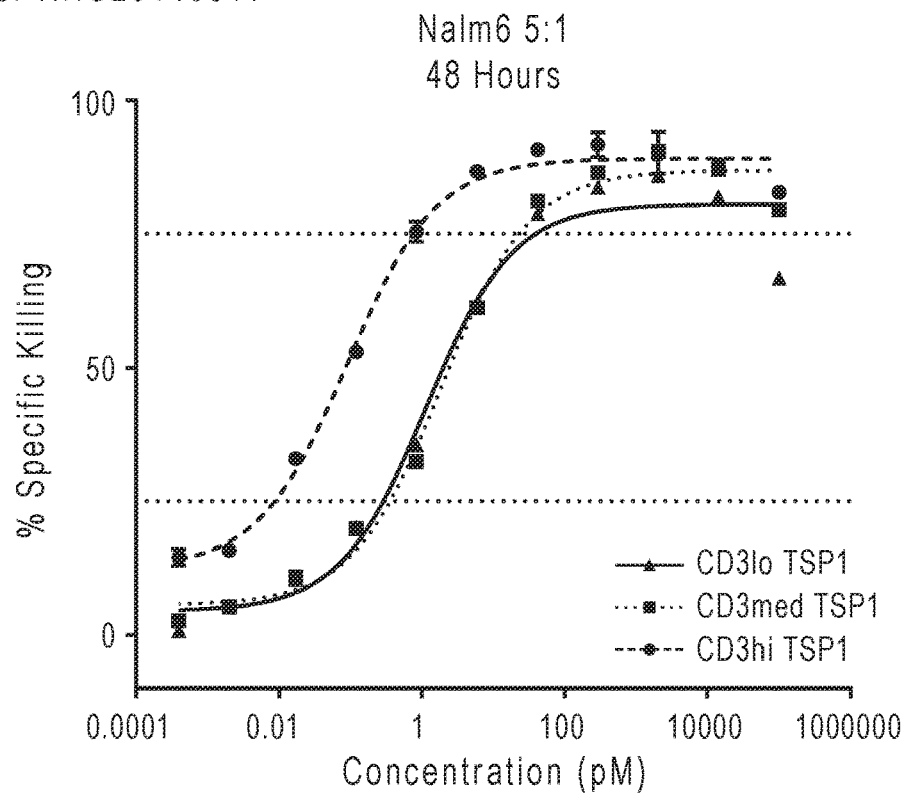
Figure 10D:
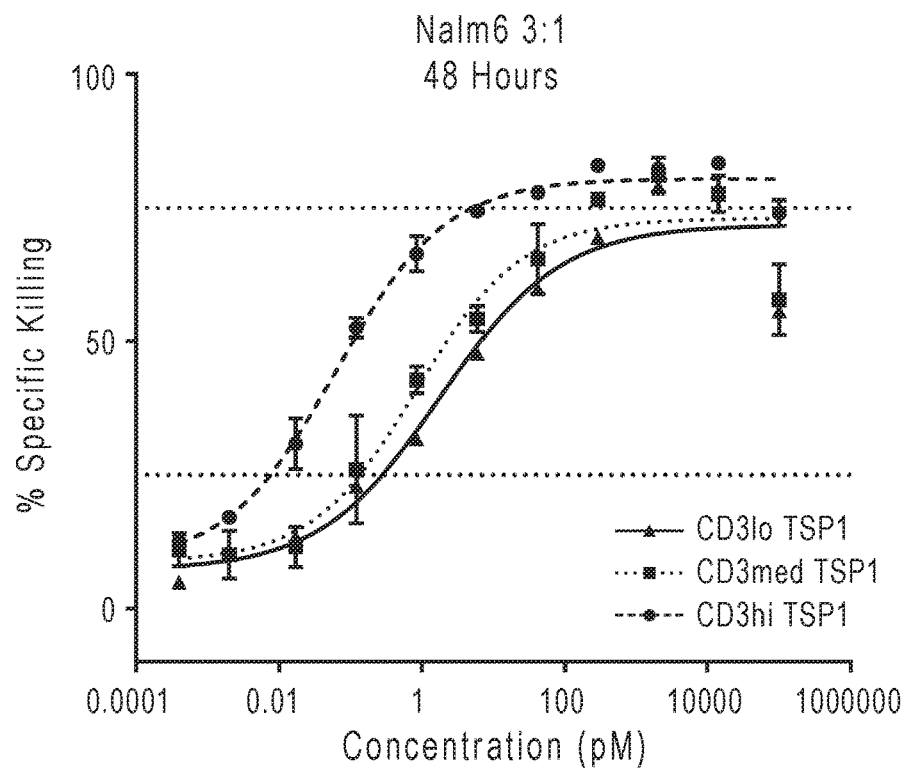
Figure 10E:
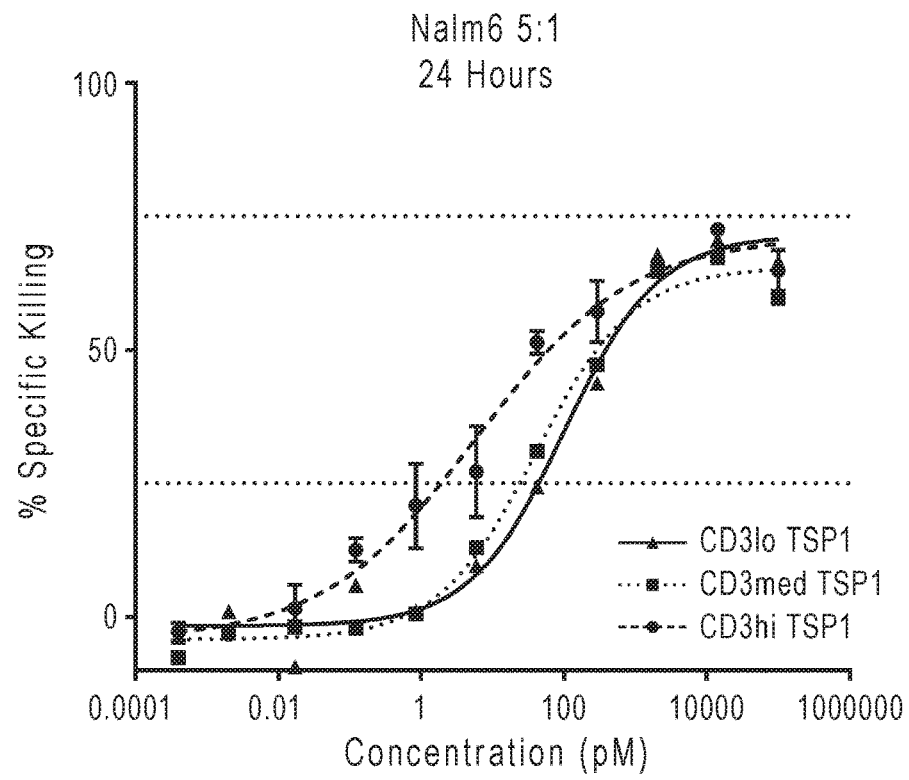
Figure 10F:
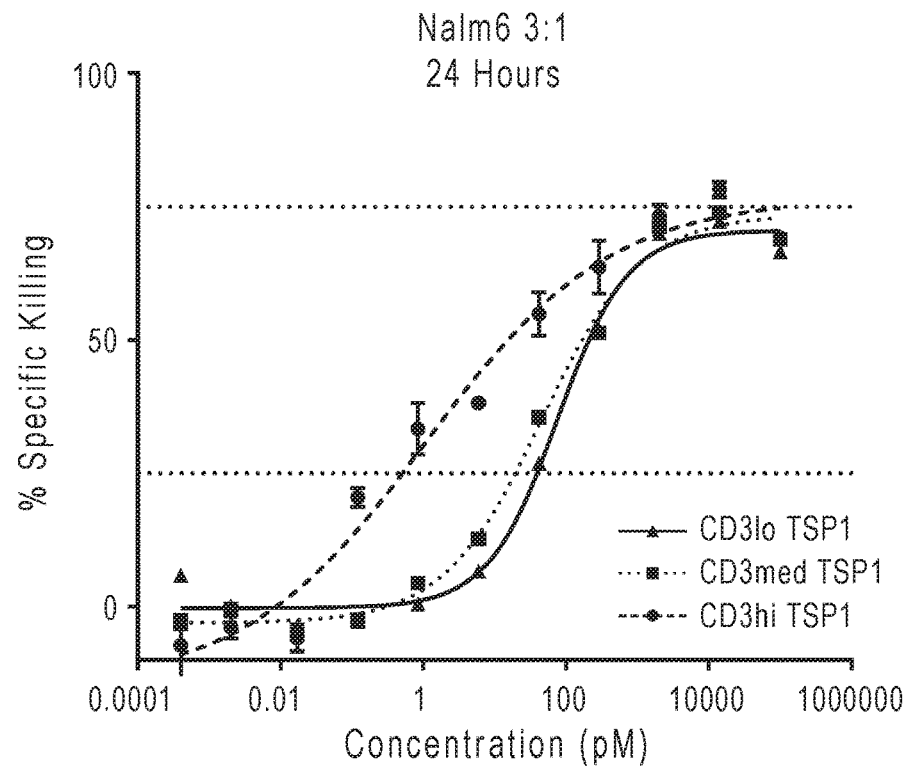
Figure 10G:
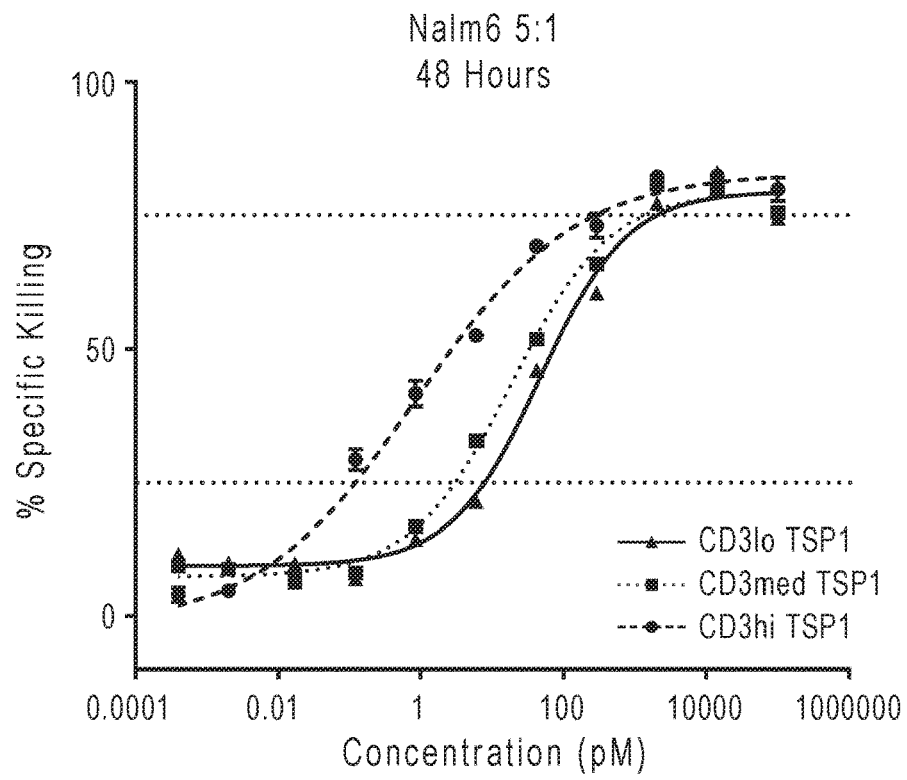
Figure 10H:
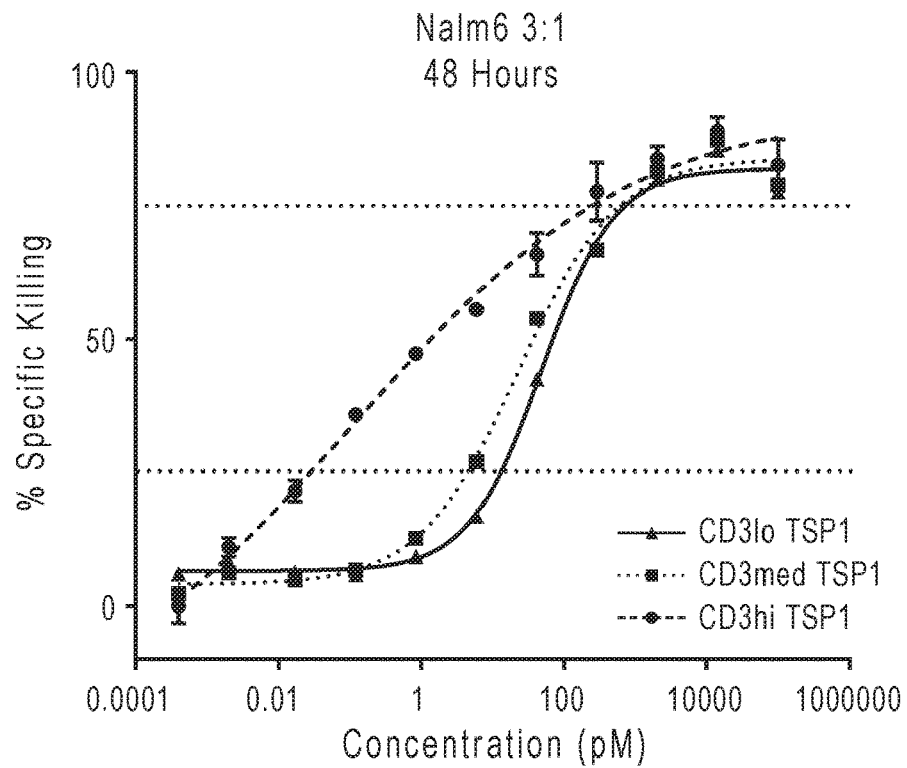
Figure 10I:
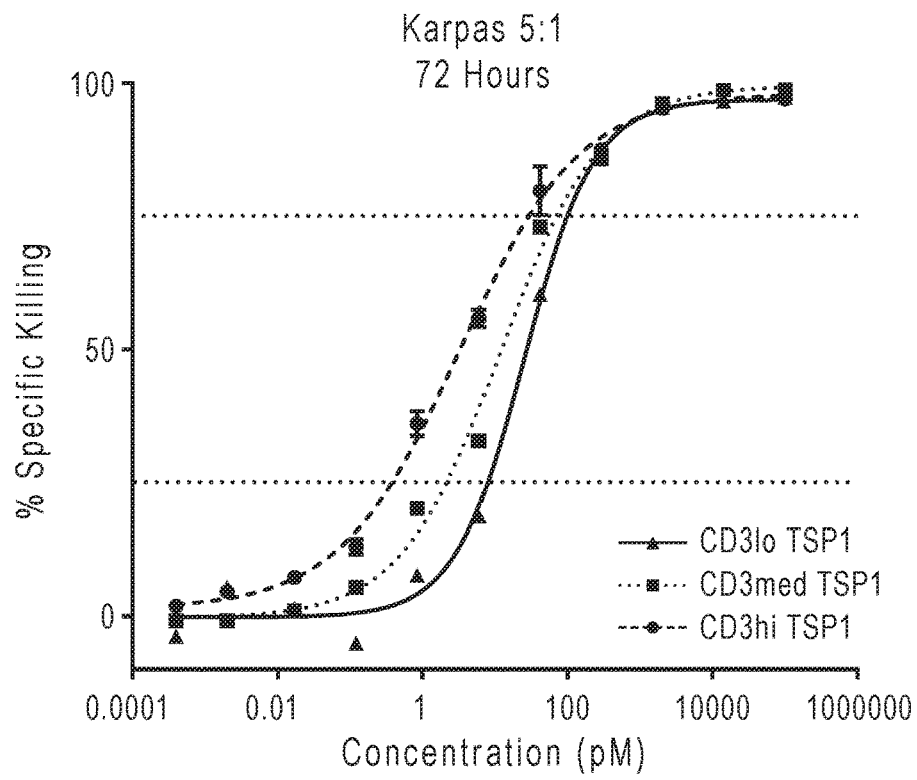
Figure 10J:
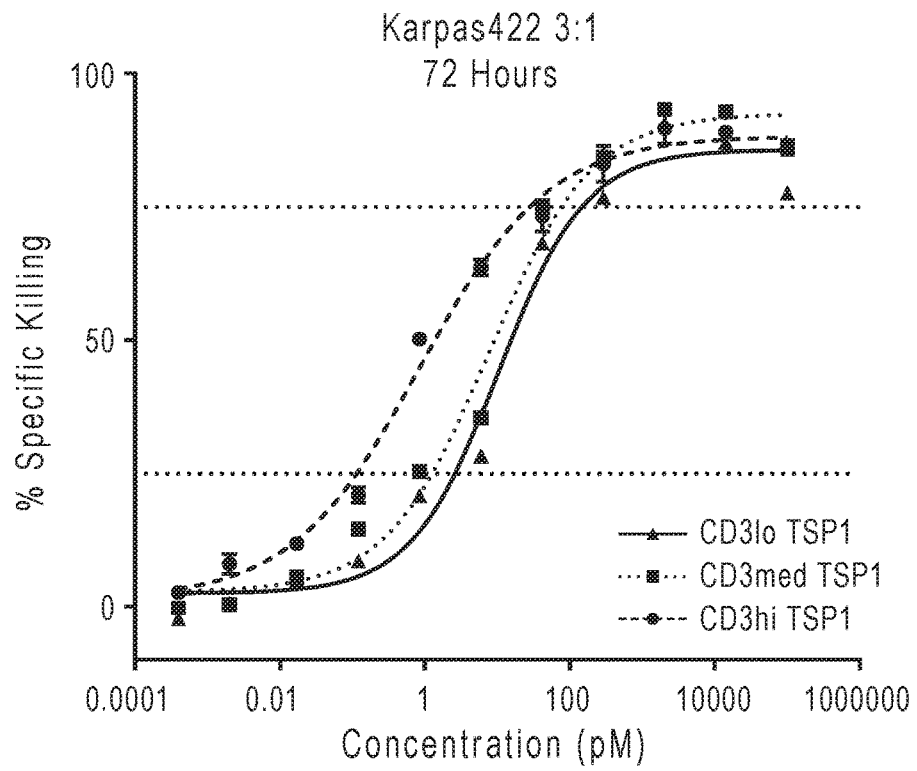
Figure 10K:
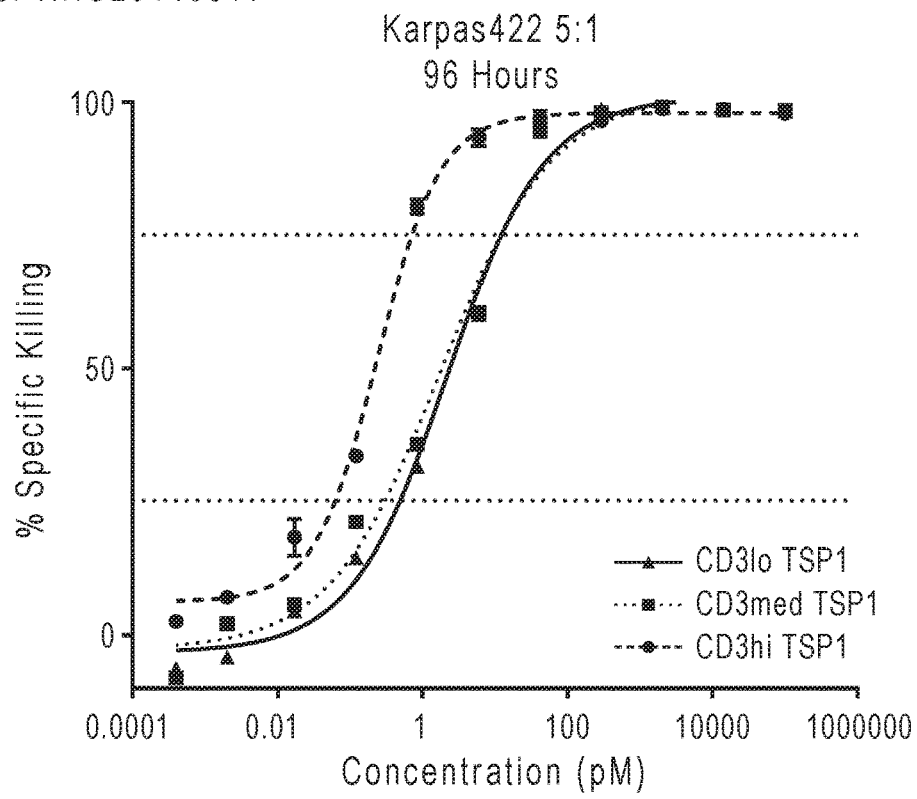
Figure 10L:
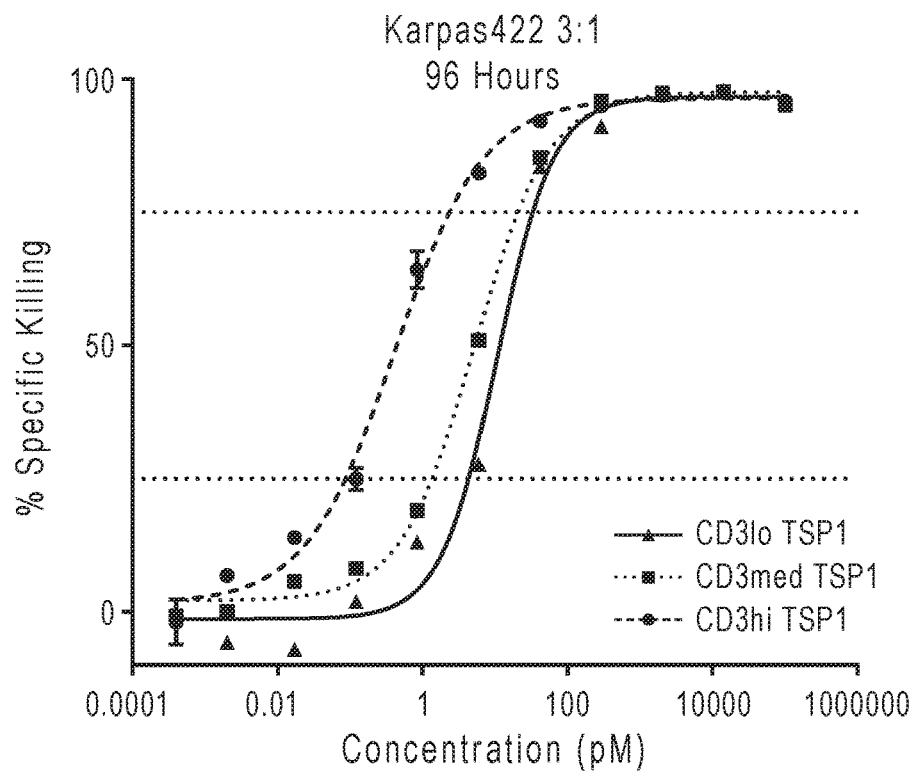
Figure 10M:
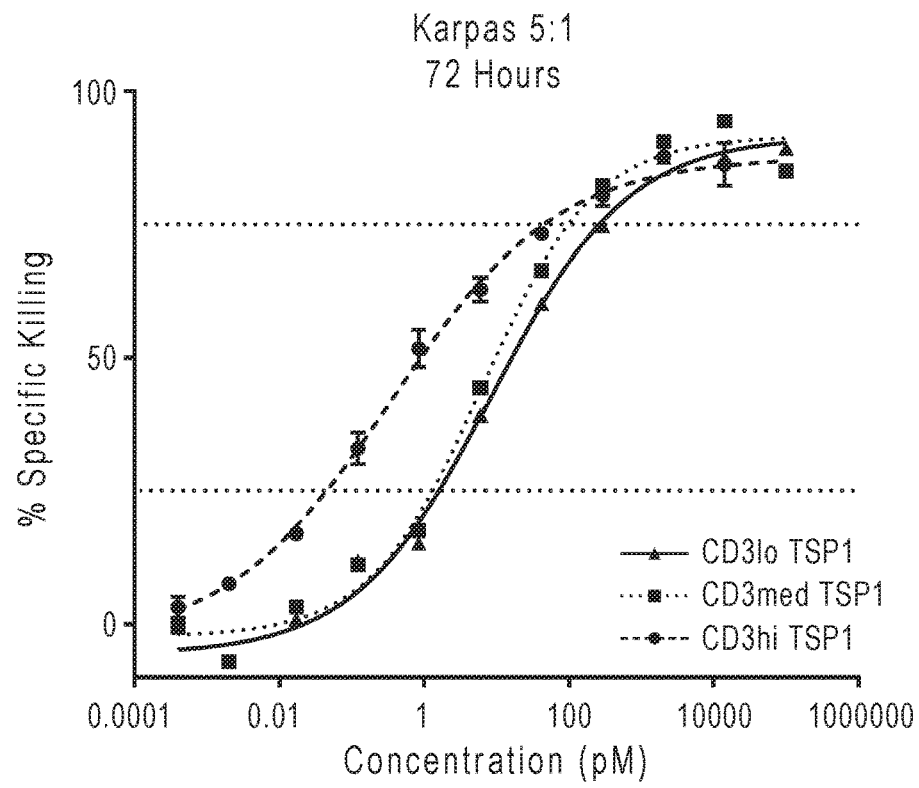
Figure 10N:
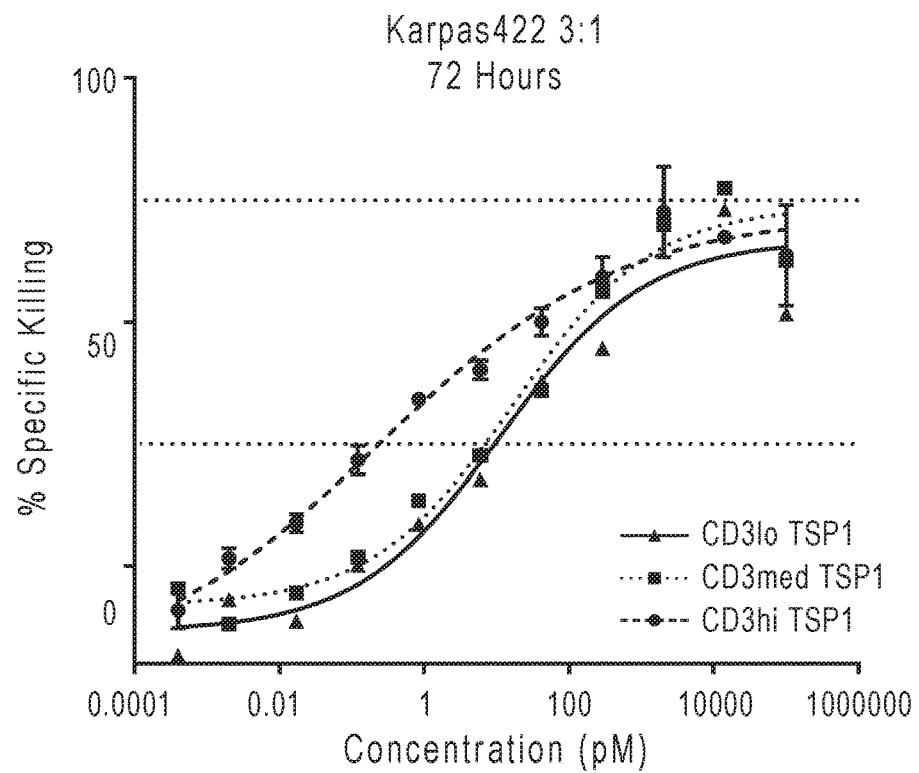
Figure 10O:
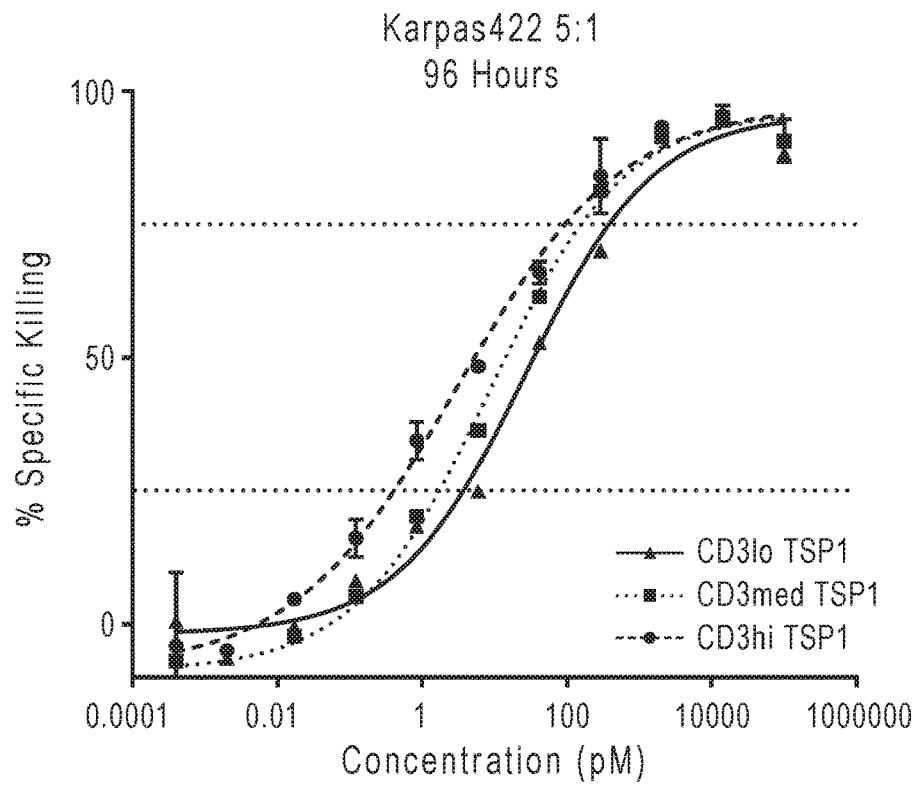
Figure 10P:
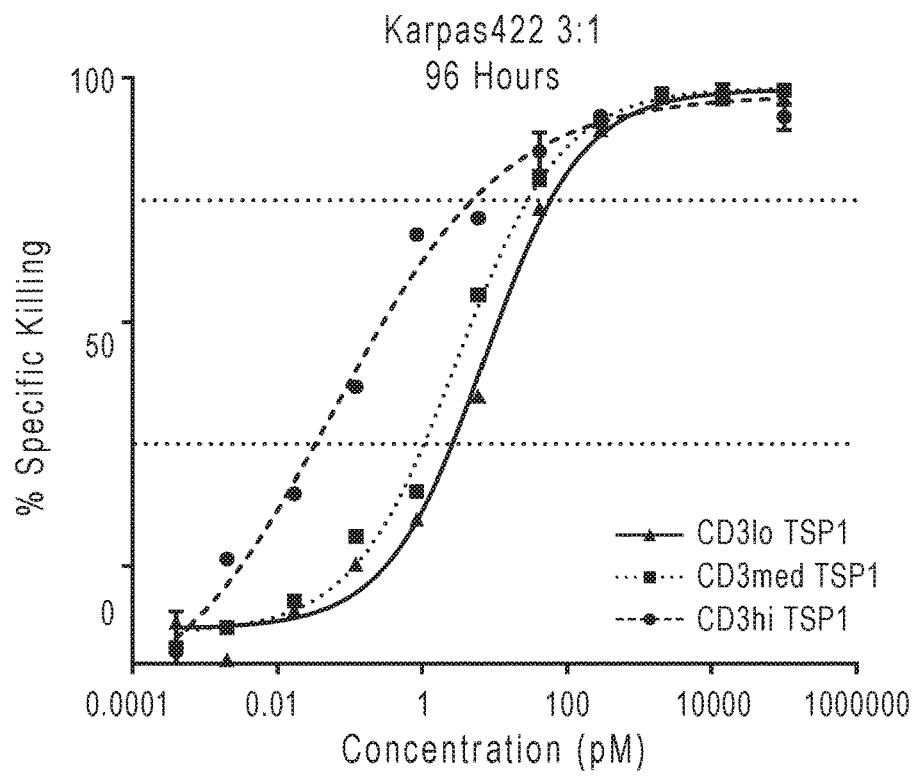
Figure 11A:
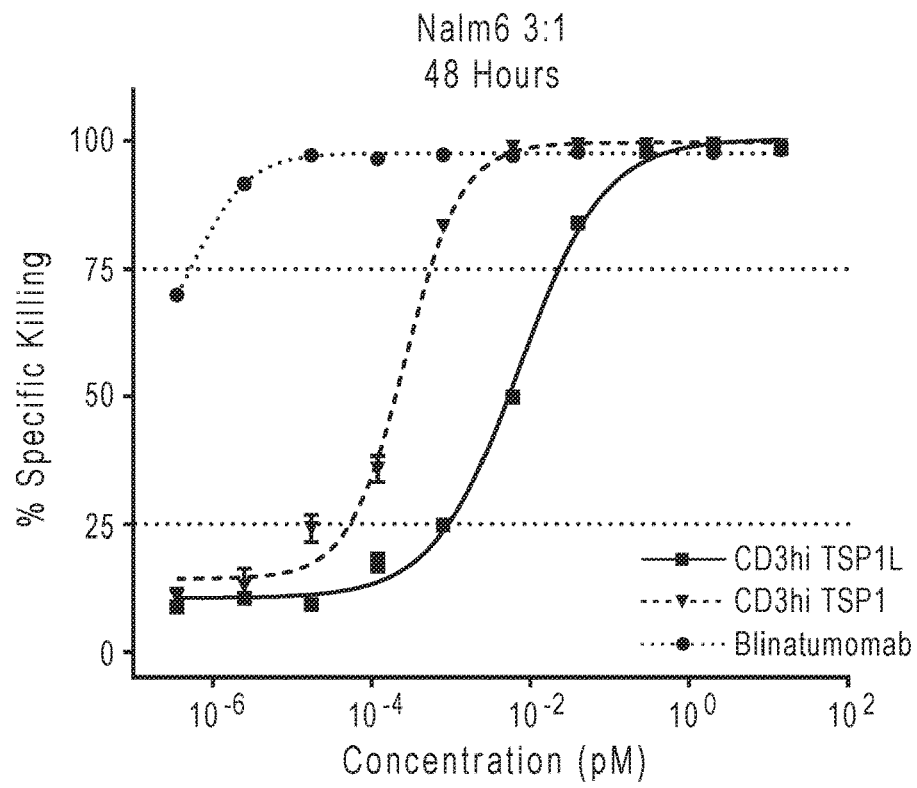
Figure 11B:
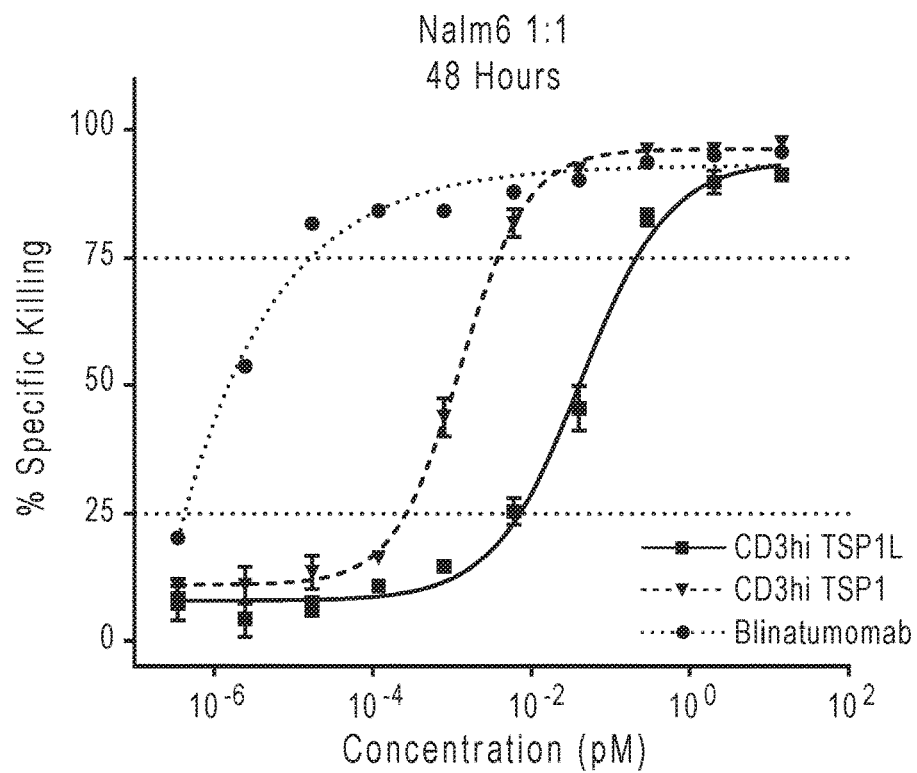
Figure 11C:
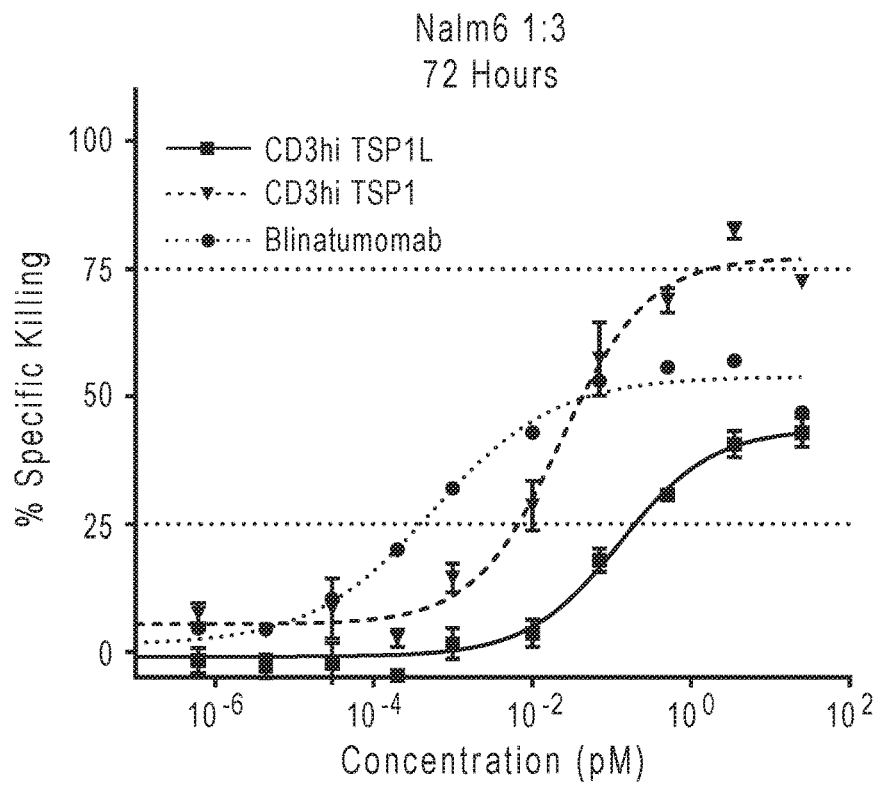
Figure 11D:
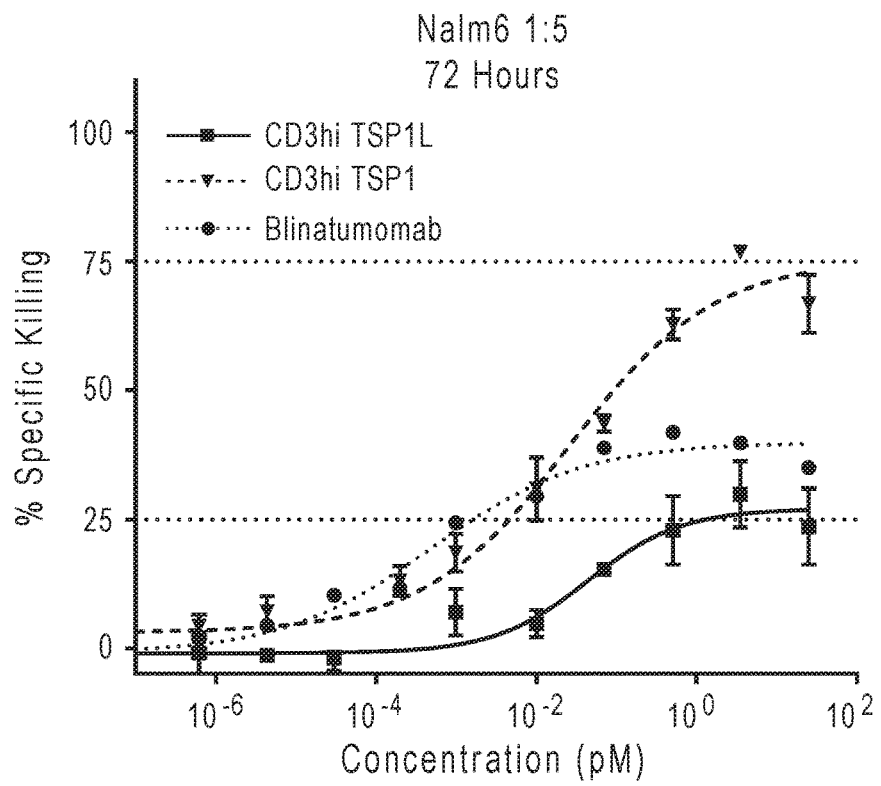
Figure 11E:
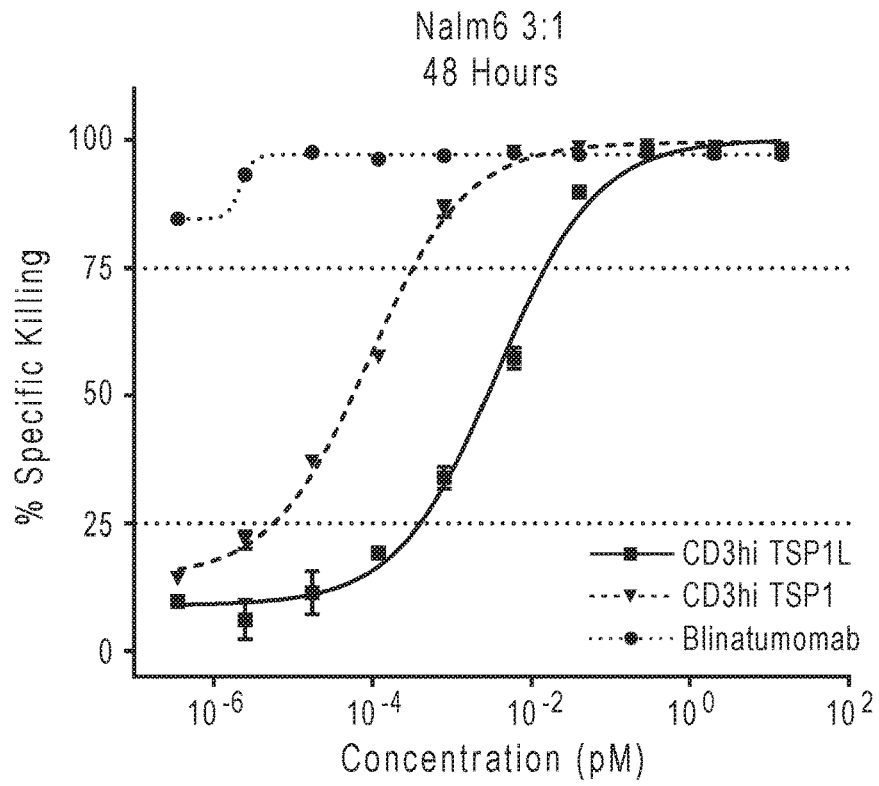
Figure 11F:
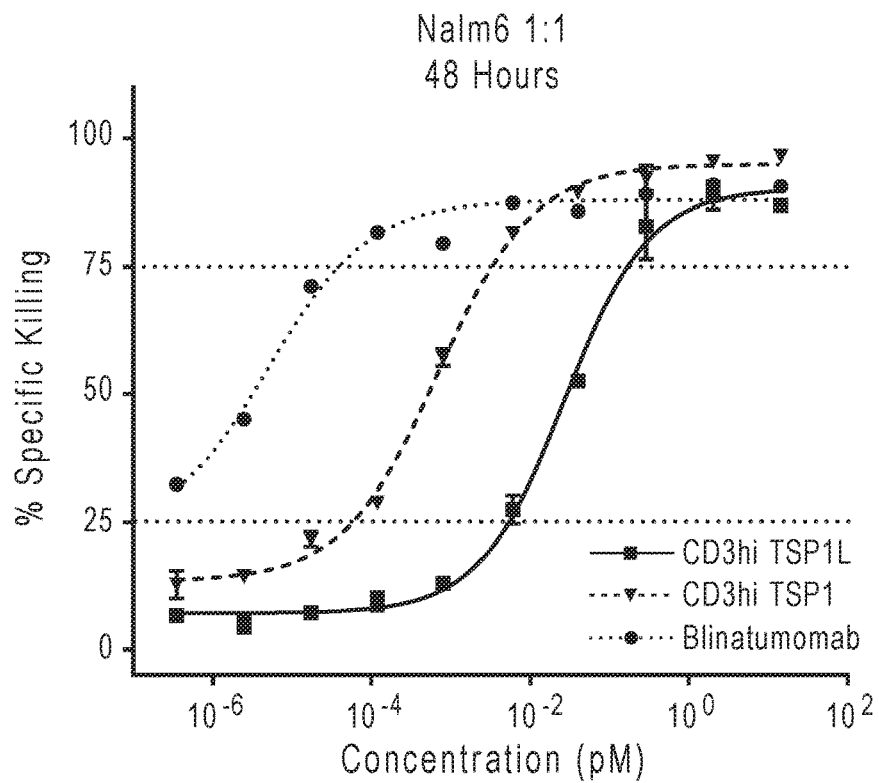
Figure 11G:
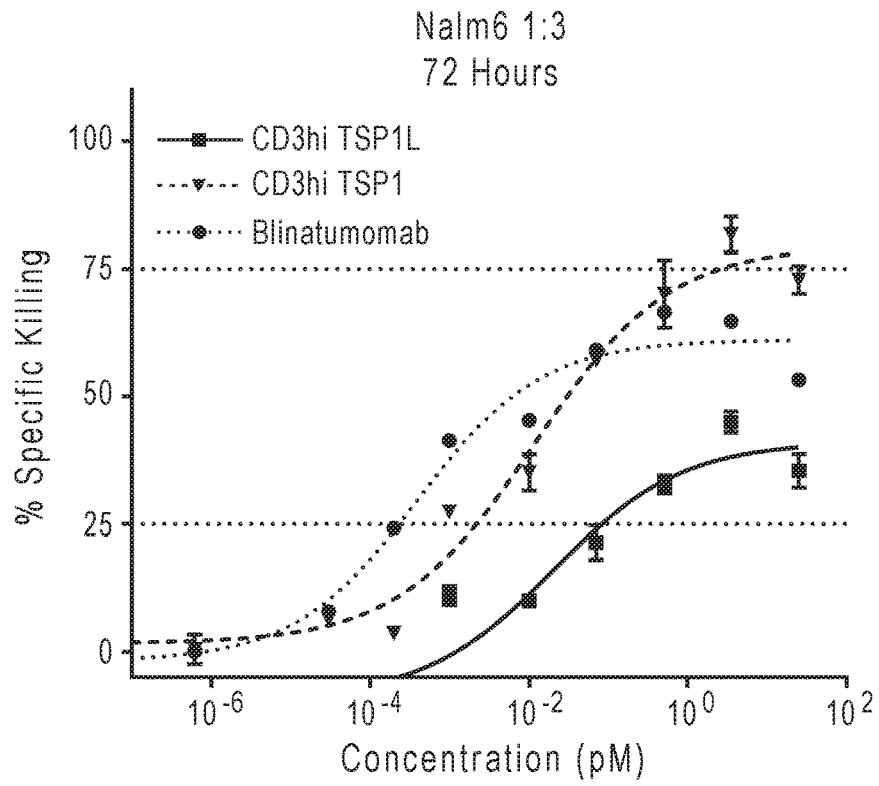
Figure 11H:
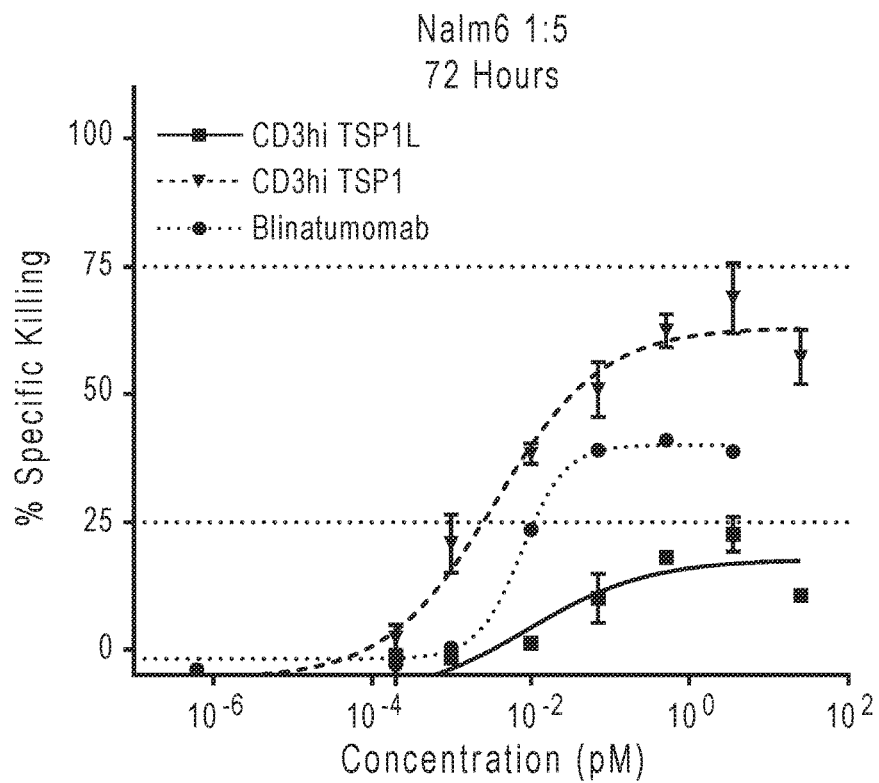
Figure 11I:
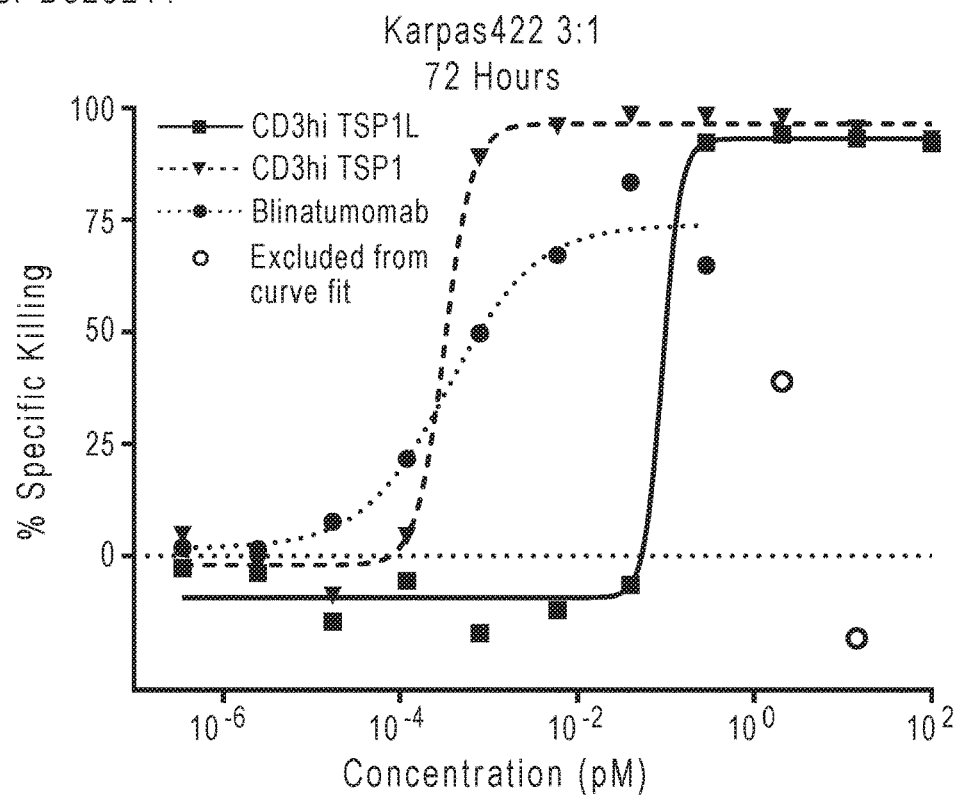
Figure 11J:
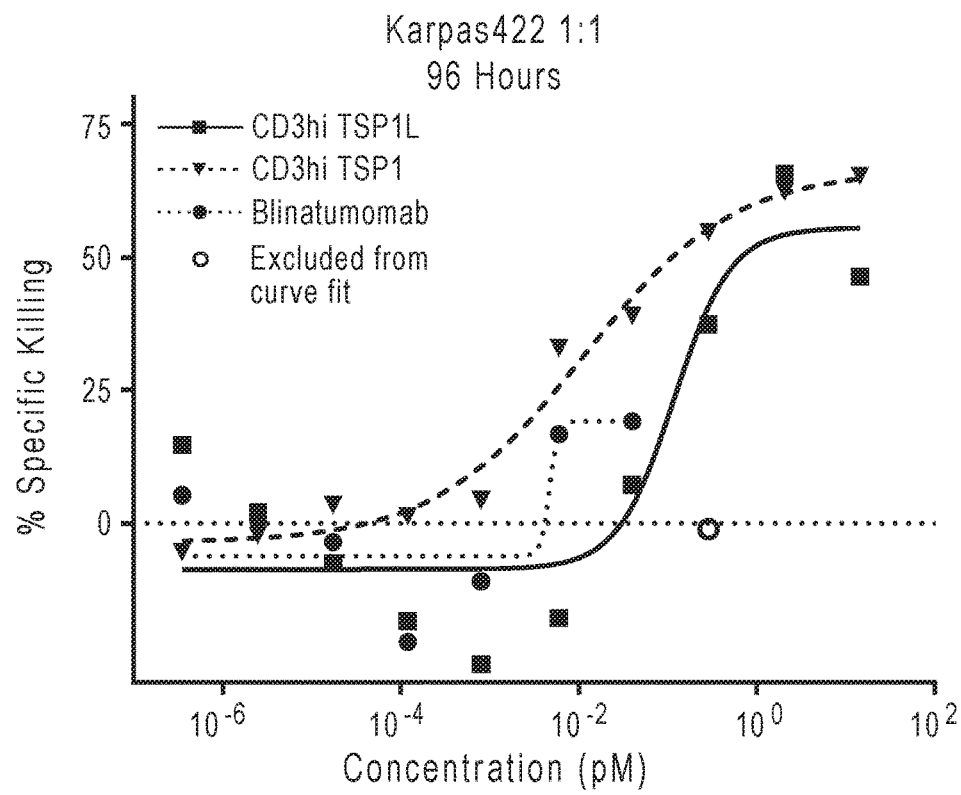
Figure 11K:
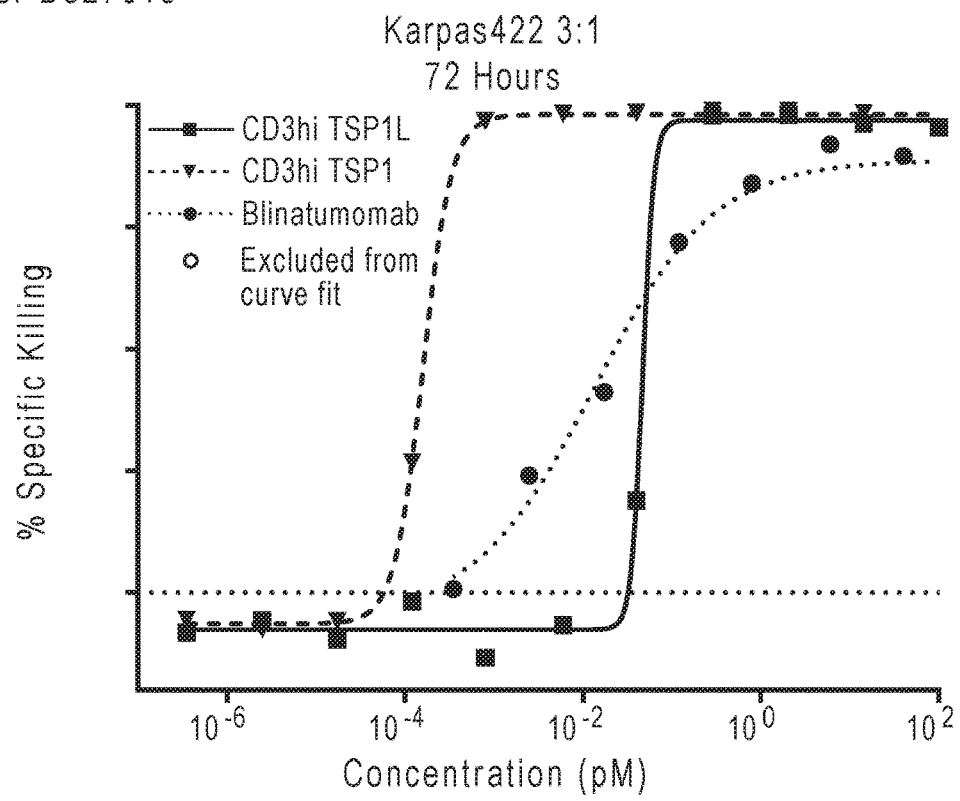
Figure 11L:
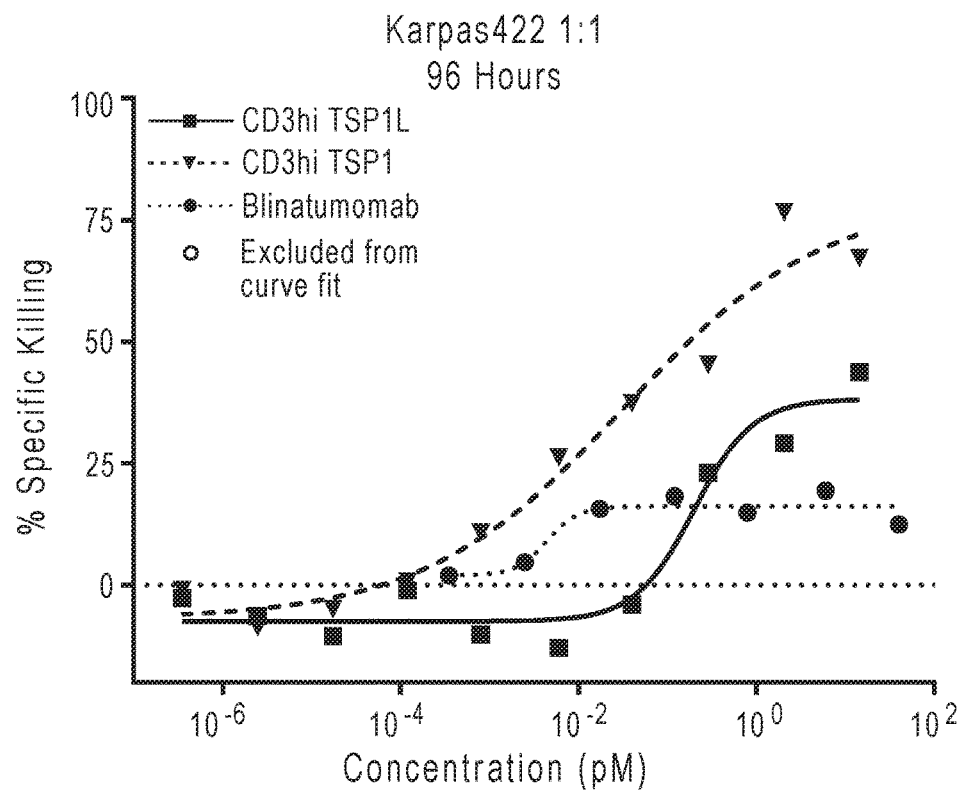

FIGS. 10A-10P: Ability of NEG258- and NEG218-based TBMs with different CD3 affinities to induce redirected T cell cytotoxicity by human donor cells against Nalm6 (FIGS. 10A-10H) and Karpas422 (FIGS. 10I-10P) target cells.

FIGS. 11A-11L: Ability of NEG258-based TBMs that include a CD2-binding arm and those that include a control lysozyme binding arm to induce redirected T cell cytotoxicity by human donor cells against Nalm6 (FIGS. 11A-11H) and Karpas422 (FIGS. 11I-11L) target cells.

Figures 12A, 12B, 12C:
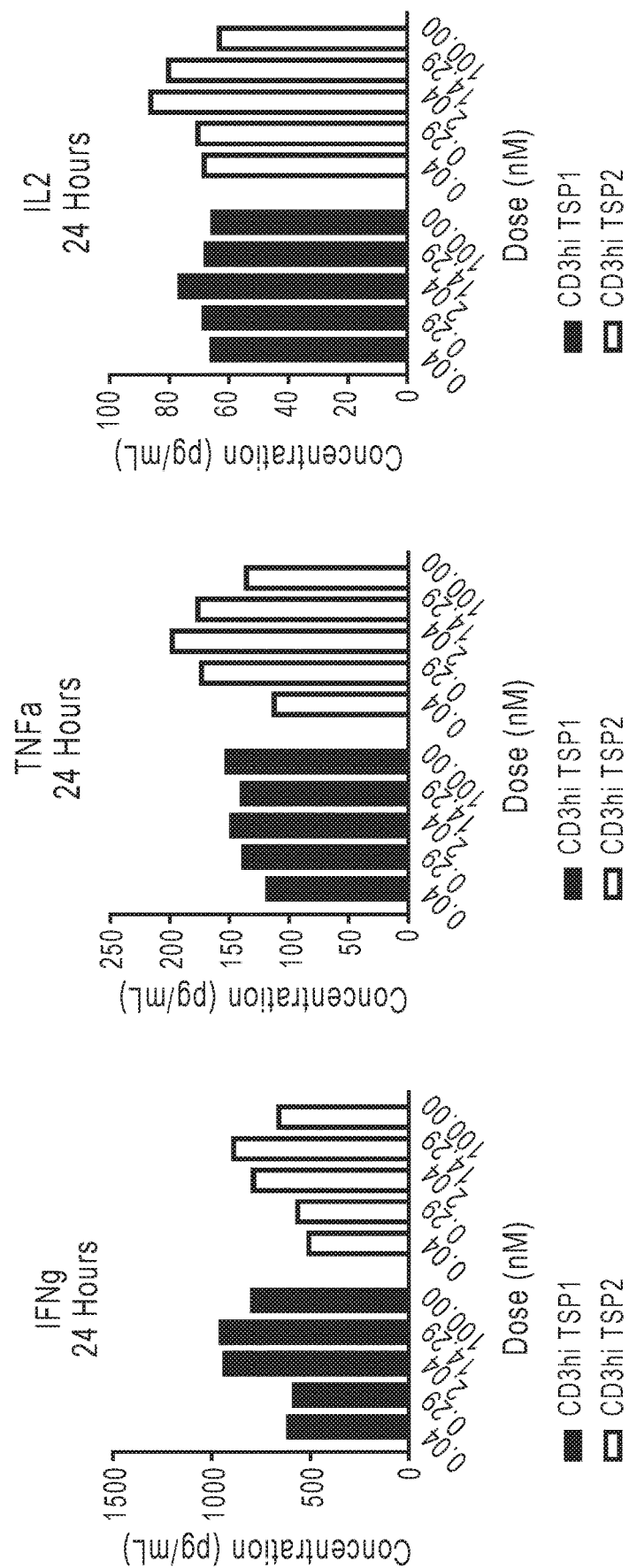

FIGS. 12A-12C: Induction of T cell cytokine release by NEG258- and NEG218-based TBMs. FIG. 12A: IFN-γ; FIG. 12B: TNF-α; FIG. 12C: IL2.

Figure 13A:
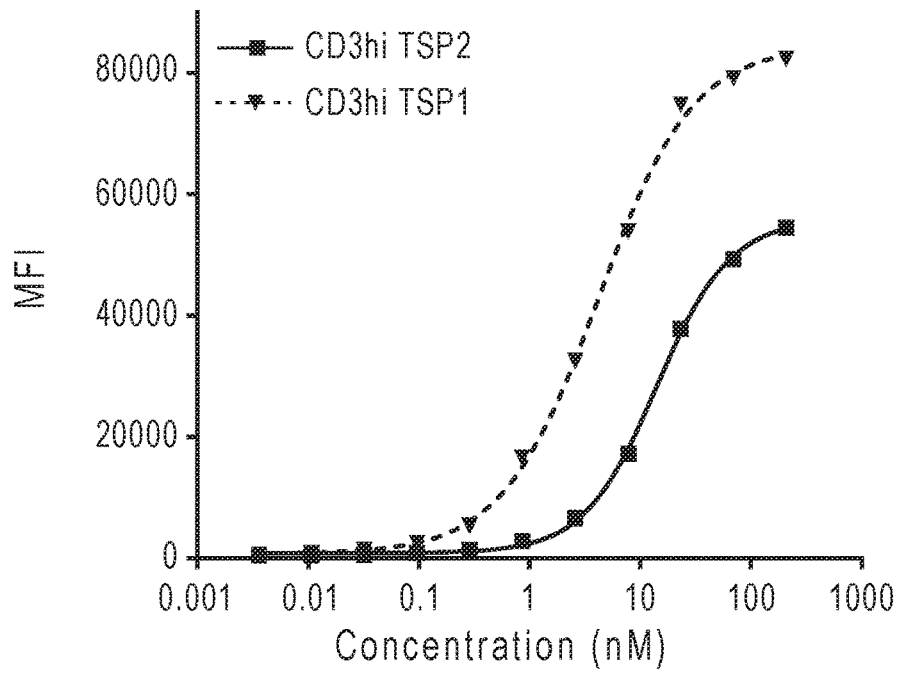
Figure 13B:
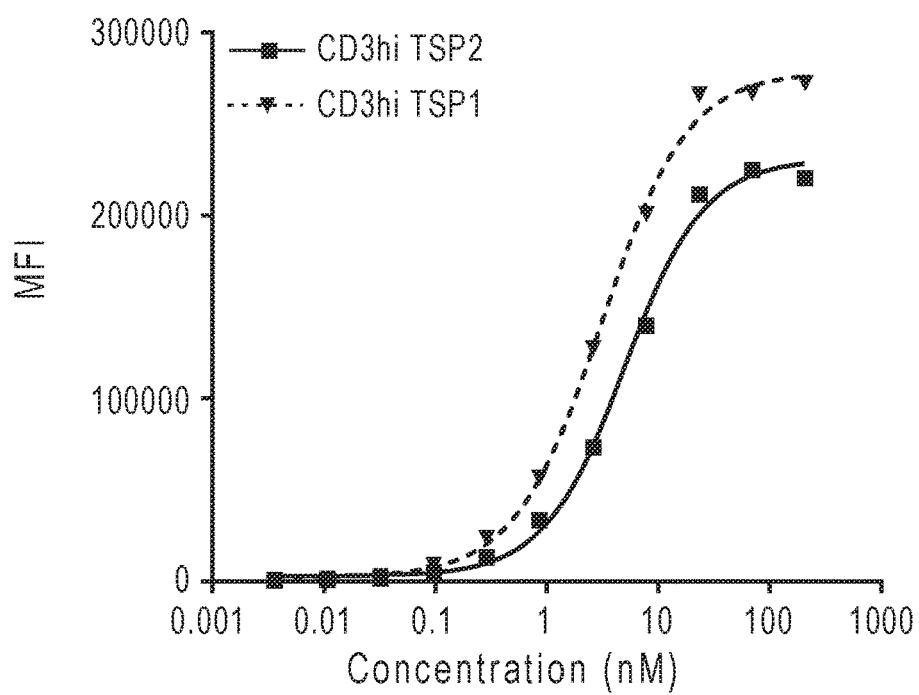
Figures 13C, 14:
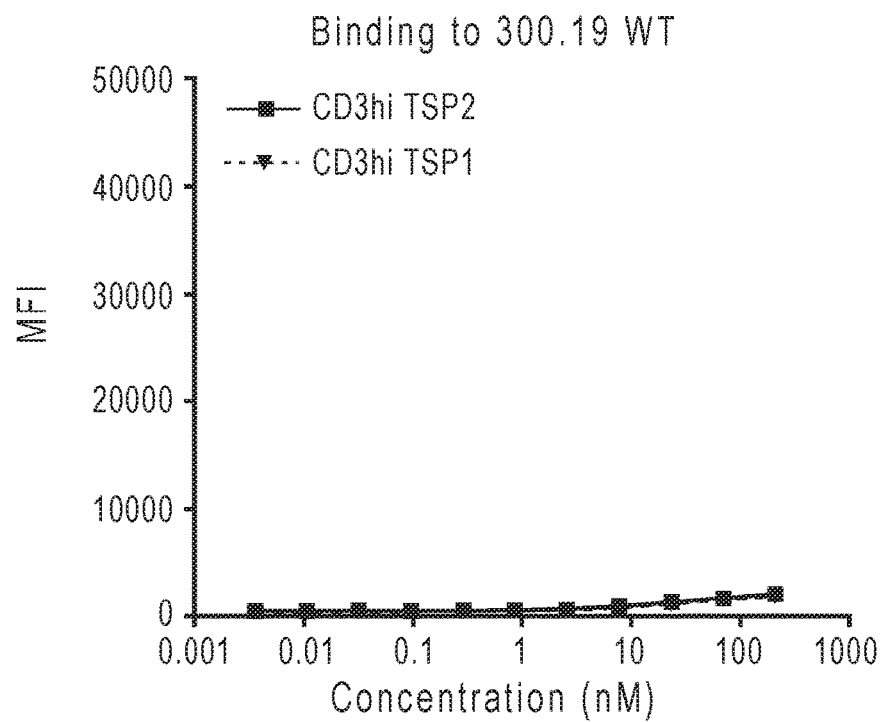

FIGS. 13A-13C: Binding of NEG258- and NEG218-based TBMs to murine 300.19 cell lines that overexpress human CD19 (FIG. 13A) or cyno CD19 (FIG. 13B). The TBMs show negligible binding to the wild type 300.19 cell line (FIG. 13C).

FIG. 14: A schematic representation of CD58.

Figure 15:
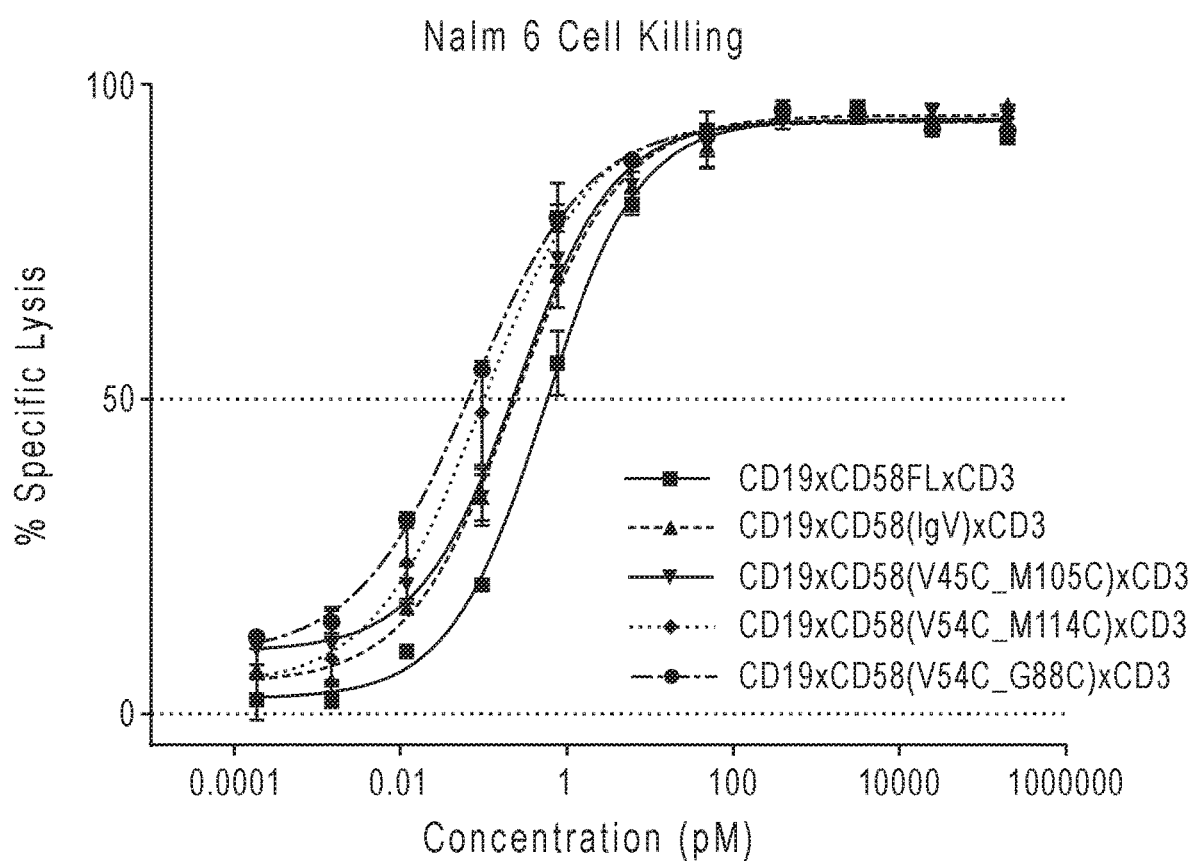

FIG. 15: Redirected T cell cytotoxicity by TBMs containing CD58 variant sequences.

Figure 16:
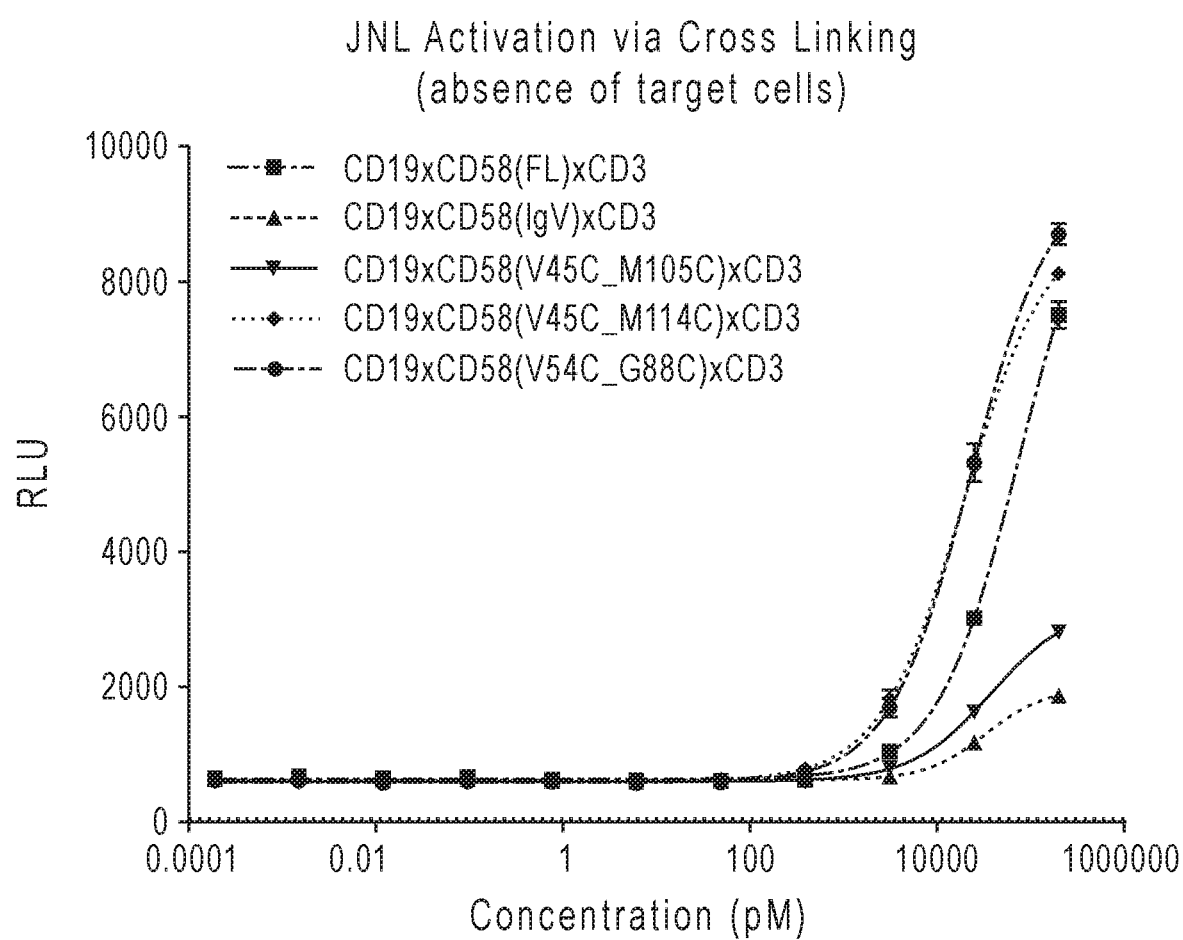

FIG. 16: Antigen-independent T-cell activation by TBMs containing CD58 variant sequences. Data expressed as relative luminescence units (RLU).

7. DETAILED DESCRIPTION

7.1. Definitions

As used herein, the following terms are intended to have the following meanings:

ABM chain: Individual ABMs can exist as one (e.g., in the case of an scFv) polypeptide chain or form through the association of more than one polypeptide chains (e.g., in the case of a Fab). As used herein, the term "ABM chain" refers to all or a portion of an ABM that exists on a single polypeptide chain. The use of the term "ABM chain" is intended for convenience and descriptive purposes only and does not connote a particular configuration or method of production.

ADCC: By "ADCC" or "antibody dependent cell-mediated cytotoxicity" as used herein is meant the cell-mediated reaction where nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

ADCP: By "ADCP" or antibody dependent cell-mediated phagocytosis as used herein is meant the cell-mediated reaction where nonspecific phagocytic cells that express FcγRs recognize bound antibody on a target cell and subsequently cause phagocytosis of the target cell.

Additional Accent: For convenience, an agent that is used in combination with an antigen-binding molecule of the disclosure is referred to herein as an "additional" agent.

Antibody: The term "antibody" as used herein refers to a polypeptide (or set of polypeptides) of the immunoglobulin family that is capable of binding an antigen non-covalently, reversibly and specifically. For example, a naturally occurring "antibody" of the IgG type is a tetramer comprising at least two heavy (H) chains and two light (L) chains interconnected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain (abbreviated herein as CL). The VH and VL regions can be further subdivided into regions of hypervariability, termed complementarity determining regions (CDR), interspersed with regions that are more conserved, termed framework regions (FR). Each VH and VL is composed of three CDRs and four FRs arranged from amino-terminus to carboxy-terminus in the following order: FR1, CDR1, FR2, CDR2, FR3, CDR3, FR4. The variable regions of the heavy and light chains contain a binding domain that interacts with an antigen. The constant regions of the antibodies can mediate the binding of the immunoglobulin to host tissues or factors, including various cells of the immune system (e.g., effector cells) and the first component (C1q) of the classical complement system. The term "antibody" includes, but is not limited to, monoclonal antibodies, human antibodies, humanized antibodies, camelised antibodies, chimeric antibodies, bispecific or multispecific antibodies and anti-idiotypic (anti-Id) antibodies (including, e.g., anti-Id antibodies to antibodies of the disclosure). The antibodies can be of any isotype/class (e.g., IgG, IgE, IgM, IgD, IgA and IgY) or subclass (e.g., IgG1, IgG2, IgG3, IgG4, IgA1 and IgA2).

Both the light and heavy chains are divided into regions of structural and functional homology. The terms "constant" and "variable" are used functionally. In this regard, it will be appreciated that the variable domains of both the light (VL) and heavy (VH) chain portions determine antigen recognition and specificity. Conversely, the constant domains of the light chain (CL) and the heavy chain (CH1, CH2 or CH3) confer important biological properties such as secretion, transplacental mobility, Fc receptor binding, complement binding, and the like. By convention the numbering of the constant region domains increases as they become more distal from the antigen-binding site or amino-terminus of the antibody. In a wild-type antibody, at the N-terminus is a variable region and at the C-terminus is a constant region; the CH3 and CL domains actually comprise the carboxy-terminus of the heavy and light chain, respectively.

Antibody fragment: The term "antibody fragment" of an antibody as used herein refers to one or more portions of an antibody. In some embodiments, these portions are part of the contact domain(s) of an antibody. In some other embodiments, these portion(s) are antigen-binding fragments that retain the ability of binding an antigen non-covalently, reversibly and specifically, sometimes referred to herein as the "antigen-binding fragment", "antigen-binding fragment thereof," "antigen-binding portion", and the like. Examples of binding fragments include, but are not limited to, single-chain Fvs (scFv), a Fab fragment, a monovalent fragment consisting of the VL, VH, CL and CH1 domains; a F(ab)2 fragment, a bivalent fragment comprising two Fab fragments linked by a disulfide bridge at the hinge region; a Fd fragment consisting of the VH and CH1 domains; a Fv fragment consisting of the VL and VH domains of a single arm of an antibody; a dAb fragment (Ward et al., 1989, Nature 341:544-546), which consists of a VH domain; and an isolated complementarity determining region (CDR). Thus, the term "antibody fragment" encompasses both proteolytic fragments of antibodies (e.g., Fab and F(ab)2 fragments) and engineered proteins comprising one or more portions of an antibody (e.g., an scFv).

Antibody fragments can also be incorporated into single domain antibodies, maxibodies, minibodies, intrabodies, diabodies, triabodies, tetrabodies, v-NAR and bis-scFv (see, e.g., Hollinger and Hudson, 2005, Nature Biotechnology 23: 1126-1136). Antibody fragments can be grafted into scaffolds based on polypeptides such as Fibronectin type III (Fn3) (see U.S. Pat. No. 6,703,199, which describes fibronectin polypeptide monobodies).

Antibody fragments can be incorporated into single chain molecules comprising a pair of tandem Fv segments (for example, VH-CH1-VH-CH1) which, together with complementary light chain polypeptides (for example, VL-VC-VL-VC), form a pair of antigen-binding regions (Zapata et al., 1995, Protein Eng. 8:1057-1062; and U.S. Pat. No. 5,641, 870).

Antibody Numbering System: In the present specification, the references to numbered amino acid residues in antibody domains are based on the EU numbering system unless otherwise specified (for example, in Table 12 or Table 17). This system was originally devised by Edelman et al., 1969, Proc. Nat'l Acad. Sci. USA 63:78-85 and is described in detail in Kabat et al., 1991, in Sequences of Proteins of Immunological Interest, US Department of Health and Human Services, NIH, USA.

Antigen-binding module: The term "antigen-binding module" or "ABM" as used herein refers to a portion of a MBM that has the ability to bind to an antigen non-covalently, reversibly and specifically. An ABM can be immunoglobulin- or non-immunoglobulin-based. As used herein, the terms "ABM1" and "CD2 ABM" (and the like) refer to an ABM that binds specifically to CD2 and comprises a variant CD58 domain. The term "ABM2" refers to an ABM that binds specifically to a component of a TCR complex or a TAA. The term "TCR ABM" (and the like) refer to an ABM that binds specifically to a component of a TCR complex. The terms "ABM3" and "TAA ABM" refer to an ABM that binds specifically to a TAA. The terms "TAA 1 ABM" and TAA 2 ABM" refer to ABMs of a MBM that bind two different TAAs. The terms ABM1, ABM2, and ABM3 are used merely for convenience and are not intended to convey any particular configuration of a MBM. In some embodiments, an ABM2 binds to CD3 (referred to herein a "CD3 ABM" or the like). Accordingly, disclosures relating to TCR ABMs are also applicable to CD3 ABMs.

Antigen-binding fragment: The term "antigen-binding fragment" of an antibody refers to a portion of an antibody that retains has the ability to bind to an antigen non-covalently, reversibly and specifically.

Antigen-binding molecule: The term "antigen-binding molecule" refers to a molecule comprising one or more antigen-binding domains, for example an antibody. The antigen-binding molecule can comprise one or more polypeptide chains, e.g., one, two, three, four or more polypeptide chains. The polypeptide chains in an antigen-binding molecule can be associated with one another directly or indirectly (for example a first polypeptide chain can be associated with a second polypeptide chain which in turn can be associated with a third polypeptide chain to form an antigen-binding molecule in which the first and second polypeptide chains are directly associated with one another, the second and third polypeptide chains are directly associated with one another, and the first and third polypeptide chains are indirectly associated with one another through the second polypeptide chain).

Associated: The term "associated" in the context of an antigen-binding molecule refers to a functional relationship between two or more polypeptide chains and/or two or more portions of a single polypeptide chain. In particular, the term "associated" means that two or more polypeptides (or portions of a single polypeptide) are associated with one another, e.g., non-covalently through molecular interactions and/or covalently through one or more disulfide bridges or chemical cross-linkages, so as to produce a functional antigen-binding molecule, e.g., a BBM or TBM in which the antigen binding domains can bind their respective targets. Examples of associations that might be present in a MBM include (but are not limited to) associations between Fc regions in an Fc domain (homodimeric or heterodimeric as described in Section 7.6.1.5), associations between VH and VL regions in a Fab or Fv, and associations between CH1 and CL in a Fab.

B cell: As used herein, the term "B cell" refers to a cell of B cell lineage, which is a type of white blood cell of the lymphocyte subtype. Examples of B cells include plasmablasts, plasma cells, lymphoplasmacytoid cells, memory B cells, follicular B cells, marginal zone B cells, B-1 cells, B-2 cells, and regulatory B cells.

B cell malignancy: As used herein, the term "B cell malignancy" refers to an uncontrolled proliferation of B cells. Examples of B cell malignancy include non-Hodgkin's lymphomas (NHL), Hodgkin's lymphomas, leukemia, and myeloma.

For example, a B cell malignancy can be, but is not limited to, multiple myeloma, chronic lymphocytic leukemia (CLL)/small lymphocytic lymphoma (SLL), follicular lymphoma, mantle cell lymphoma (MCL), diffuse large B-cell lymphoma (DLBCL), marginal zone lymphomas, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, and primary effusion lymphoma, and plasmacytic dendritic cell neoplasms.

Binding Sequences: In reference to Tables 12, 13, 15, 16, or 17 (including subparts thereof), the term "binding sequences" means an ABM having a full set of CDRs, a VH-VL pair, or an scFv set forth in that table.

Bispecific binding molecule: The term "bispecific binding molecule" or "BBM" refers to a molecule that specifically binds to two antigens and comprises two or more ABMs. The BBMs of the disclosure comprise a variant CD58 domain of the disclosure that binds to CD2 and at least one antigen-binding module which is specific for a different antigen, e.g., component of a TCR complex or a TAA. Representative BBMs are illustrated in FIG. 1B-1AH. BBMs can comprise one, two, three, four or even more polypeptide chains. In the BBMs of the disclosure, a variant CD58 domain can substitute for a Fab and/or scFv in any of the configurations illustrated.

Bivalent: The term "bivalent" as used herein in the context of an antigen-binding molecule refers to an antigen-binding molecule that has two antigen-binding domains. The domains can be the same or different. Accordingly, a bivalent antigen-binding molecule can be monospecific or bispecific. Bivalent BBMs can comprise a variant CD58 domain that binds to CD2 and another ABM that binds to another antigen, e.g., a component of the TCR complex or a TAA.

Cancer: The term "cancer" refers to a disease characterized by the uncontrolled (and often rapid) growth of aberrant cells. Cancer cells can spread locally or through the bloodstream and lymphatic system to other parts of the body. Examples of various cancers are described herein and include but are not limited to, leukemia, multiple myeloma, asymptomatic myeloma, Hodgkin's lymphoma and non-Hodgkin's lymphoma. The term "cancerous B cell" refers to a B cell that is undergoing or has undergone uncontrolled proliferation.

CD3: The term "CD3" or "cluster of differentiation 3" refers to the cluster of differentiation 3 co-receptor of the T cell receptor. CD3 helps in activation of both cytotoxic T-cell (e.g., CD8+ naïve T cells) and T helper cells (e.g., CD4+ naïve T cells) and is composed of four distinct chains: one CD3γ chain (e.g., Genbank Accession Numbers NM_000073 and MP_000064 (human)), one CD3δ chain (e.g., Genbank Accession Numbers NM_000732, NM_001040651, NP_00732 and NP_001035741 (human)), and two CD3ε chains (e.g., Genbank Accession Numbers NM_000733 and NP_00724 (human)). The chains of CD3 are highly related cell-surface proteins of the immunoglobulin superfamily containing a single extracellular immunoglobulin domain. The CD3 molecule associates with the T-cell receptor (TCR) and ζ-chain to form the T-cell receptor (TCR) complex, which functions in generating activation signals in T lymphocytes. Unless expressly indicated otherwise, the reference to CD3 in the application can refer to the CD3 co-receptor, the CD3 co-receptor complex, or any polypeptide chain of the CD3 co-receptor complex.

CD19: The term "CD19" or "cluster of differentiation 19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. CD19 is expressed on most B lineage cancers, including, e.g., acute lymphoblastic leukaemia, chronic lymphocyte leukaemia and non-Hodgkin's lymphoma. Other cells with express CD19 are provided below in the definition of "disease associated with expression of CD19." It is also an early marker of B cell progenitors. See, e.g., Nicholson et al., 1997, Mol. Immun. 34 (16-17): 1157-1165.

Chimeric Antibody: The term "chimeric antibody" (or antigen-binding fragment thereof) is an antibody molecule (or antigen-binding fragment thereof) in which (a) the constant region, or a portion thereof, is altered, replaced or exchanged so that the antigen-binding site (variable region) is linked to a constant region of a different or altered class, effector function and/or species, or an entirely different molecule which confers new properties to the chimeric antibody, e.g., an enzyme, toxin, hormone, growth factor, drug, etc.; or (b) the variable region, or a portion thereof, is altered, replaced or exchanged with a variable region having a different or altered antigen specificity. For example, a mouse antibody can be modified by replacing its constant region with the constant region from a human immunoglobulin. Due to the replacement with a human constant region, the chimeric antibody can retain its specificity in recognizing the antigen while having reduced antigenicity in human as compared to the original mouse antibody.

In combination: Administered "in combination," as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons.

Complementarity Determining Region: The terms "complementarity determining region" or "CDR," as used herein, refer to the sequences of amino acids within antibody variable regions which confer antigen specificity and binding affinity. For example, in general, there are three CDRs in each heavy chain variable region (e.g., CDR-H1, CDR-H2, and CDR-H3) and three CDRs in each light chain variable region (CDR-L1, CDR-L2, and CDR-L3). The precise amino acid sequence boundaries of a given CDR can be determined using any of a number of well-known schemes, including those described by Kabat et al., 1991, "Sequences of Proteins of Immunological Interest," 5th Ed. Public Health Service, National Institutes of Health, Bethesda, MD ("Kabat" numbering scheme), AI-Lazikani et al., 1997, JMB 273:927-948 ("Chothia" numbering scheme) and ImMunoGenTics (IMGT) numbering (Lefranc, 1999, The Immunologist 7:132-136; Lefranc et al., 2003, Dev. Comp. Immunol. 27:55-77 ("IMGT" numbering scheme). For example, for classic formats, under Kabat, the CDR amino acid residues in the heavy chain variable domain (VH) are numbered 31-35 (CDR-H1), 50-65 (CDR-H2), and 95-102 (CDR-H3); and the CDR amino acid residues in the light chain variable domain (VL) are numbered 24-34 (CDR-L1), 50-56 (CDR-L2), and 89-97 (CDR-L3). Under Chothia, the CDR amino acids in the VH are numbered 26-32 (CDR-H1), 52-56 (CDR-H2), and 95-102 (CDR-H3); and the amino acid residues in VL are numbered 26-32 (CDR-L1), 50-52 (CDR-L2), and 91-96 (CDR-L3). By combining the CDR definitions of both Kabat and Chothia, the CDRs consist of amino acid residues 26-35 (CDR-H1), 50-65 (CDR-H2), and 95-102 (CDR-H3) in human VH and amino acid residues 24-34 (CDR-L1), 50-56 (CDR-L2), and 89-97 (CDR-L3) in human VL. Under IMGT the CDR amino acid residues in the VH are numbered approximately 26-35 (CDR-H1), 51-57 (CDR-H2) and 93-102 (CDR-H3), and the CDR amino acid residues in the VL are numbered approximately 27-32 (CDR-L1), 50-52 (CDR-L2), and 89-97 (CDR-L3) (numbering according to "Kabat"). Under IMGT, the CDR regions of an antibody can be determined using the program IMGT/DomainGap Align.

Concurrently: The term "concurrently" is not limited to the administration of therapies (e.g., prophylactic or therapeutic agents) at exactly the same time, but rather it is meant that a pharmaceutical composition comprising an antigen-binding molecule of the disclosure is administered to a subject in a sequence and within a time interval such that the molecules can act together with the additional therapy(ies) to provide an increased benefit than if they were administered otherwise.

Conservative Sequence Modifications: The term "conservative sequence modifications" refers to amino acid modifications that do not significantly affect or alter the binding characteristics of a CD2 binding molecule or a component thereof (e.g., a CD2-binding portion of CD58). Such conservative modifications include amino acid substitutions, additions and deletions. Modifications can be introduced into a binding molecule by standard techniques, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a binding molecule can be replaced with other amino acid residues from the same side chain family and the altered binding molecule can be tested for, e.g., binding to target molecules and/or effective heterodimerization and/or effector function.

Correspond: Generally, and unless indicated otherwise, the terms "correspond" and "corresponding" with respect to nucleotide or amino acid positions of a nucleic acid or polypeptide sequence, refer to nucleotides or amino acid positions identified upon alignment of a query sequence with all or a portion (e.g., a domain) of a reference sequence to maximize identity. For example, the variant CD58 domains of the disclosure include cysteine substitutions as compared to the corresponding domains in wild type CD58, for example as compared to the entire CD58 protein as set forth in SEQ ID NO:1, the extracellular domain as set forth in SEQ ID NO:4, or the Ig-V-like domain as set forth in SEQ ID NO:6.

Diabody: The term "diabody" as used herein refers to small antibody fragments with two antigen-binding sites, typically formed by pairing of scFv chains. Each scFv comprises a heavy chain variable domain (VH) connected to a light chain variable domain (VL) in the same polypeptide chain (VH-VL, where the VH is either N-terminal or C-terminal to the VL). Unlike a typical scFv in which the VH and VL are separated by a linker that allows the VH and VL on the same polypeptide chain to pair and form an antigen-binding domain, diabodies typically comprise a linker that is too short to allow pairing between the VH and VL domains on the same chain, forcing the VH and VL domains to pair with the complementary domains of another chain and create two antigen-binding sites. Diabodies are described more fully in, for example, EP 404,097; WO 93/11161; and Hollinger et al., 1993, Proc. Natl. Acad. Sci. USA 90:6444-6448.

dsFv: The term "dsFv" refers to disulfide-stabilized Fv fragments. In a dsFv, a VH and VL are connected by an interdomain disulfide bond. To generate such molecules, one amino acid each in the framework region of in VH and VL are mutated to a cysteine, which in turn form a stable interchain disulfide bond. Typically, position 44 in the VH and position 100 in the VL are mutated to cysteines. See Brinkmann, 2010, Antibody Engineering 181-189, DOI: 10.1007/978-3-642-01147-4_14. The term dsFv encompasses both what is known as a dsFv (a molecule in which the VH and VL are connected by an interchain disulfide bond but not a linker peptide) or scdsFv (a molecule in which the VH and VL are connected by a linker as well as an interchain disulfide bond).

Effector Function: The term "effector function" refers to an activity of an antibody molecule that is mediated by binding through a domain of the antibody other than the antigen-binding domain, usually mediated by binding of effector molecules. Effector function includes complement-mediated effector function, which is mediated by, for example, binding of the C1 component of the complement to the antibody. Activation of complement is important in the opsonization and lysis of cell pathogens. The activation of complement also stimulates the inflammatory response and may also be involved in autoimmune hypersensitivity. Effector function also includes Fc receptor (FcR)-mediated effector function, which can be triggered upon binding of the constant domain of an antibody to an Fc receptor (FcR). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production. An effector function of an antibody can be altered by altering, e.g., enhancing or reducing, the affinity of the antibody for an effector molecule such as an Fc receptor or a complement component. Binding affinity will generally be varied by modifying the effector molecule binding site, and in this case it is appropriate to locate the site of interest and modify at least part of the site in a suitable way. It is also envisaged that an alteration in the binding site on the antibody for the effector molecule need not alter significantly the overall binding affinity but can alter the geometry of the interaction rendering the effector mechanism ineffective as in non-productive binding. It is further envisaged that an effector function can also be altered by modifying a site not directly involved in effector molecule binding, but otherwise involved in performance of the effector function.

Epitope: An epitope, or antigenic determinant, is a portion of an antigen recognized by an antibody or other antigen-binding moiety as described herein. An epitope can be linear or conformational.

Fab: By "Fab" or "Fab region" as used herein is meant a polypeptide region that comprises the VH, CH1, VL, and CL immunoglobulin domain. These terms can refer to this region in isolation, or this region in the context of an antigen-binding molecule of the disclosure.

Fab domains are formed by association of a CH1 domain attached to a VH domain with a CL domain attached to a VL domain. The VH domain is paired with the VL domain to constitute the Fv region, and the CH1 domain is paired with the CL domain to further stabilize the binding module. A disulfide bond between the two constant domains can further stabilize the Fab domain.

Fab regions can be produced by proteolytic cleavage of immunoglobulin molecules (e.g., using enzymes such as papain) or through recombinant expression. In native immunoglobulin molecules, Fabs are formed by association of two different polypeptide chains (e.g., VH-CH1 on one chain associates with VL-CL on the other chain). The Fab regions are typically expressed recombinantly, typically on two polypeptide chains, although single chain Fabs are also contemplated herein.

Fc domain: The term "Fc domain" refers to a pair of associated Fc regions. The two Fc regions dimerize to create the Fc domain. The two Fc regions within the Fc domain can be the same (such an Fc domain being referred to herein as an "Fc homodimer") or different from one another (such an Fc domain being referred to herein as an "Fc heterodimer").

Fc region: The term "Fc region" or "Fc chain" as used herein is meant the polypeptide comprising the CH2-CH3 domains of an IgG molecule, and in some cases, inclusive of the hinge. In EU numbering for human IgG1, the CH2-CH3 domain comprises amino acids 231 to 447, and the hinge is 216 to 230. Thus the definition of "Fc region" includes both amino acids 231-447 (CH2-CH3) or 216-447 (hinge-CH2-CH3), or fragments thereof. An "Fc fragment" in this context can contain fewer amino acids from either or both of the N- and C-termini but still retains the ability to form a dimer with another Fc region as can be detected using standard methods, generally based on size (e.g., non-denaturing chromatography, size exclusion chromatography). Human IgG Fc regions are of particular use in the present disclosure, and can be the Fc region from human IgG1, IgG2 or IgG4.

Fv: The term "Fv" refers to the minimum antibody fragment derivable from an immunoglobulin that contains a complete target recognition and binding site. This region consists of a dimer of one heavy and one light chain variable domain in a tight, noncovalent association (VH-VL dimer). It is in this configuration that the three CDRs of each variable domain interact to define a target binding site on the surface of the VH-VL dimer. Often, the six CDRs confer target binding specificity to the antibody. However, in some instances even a single variable domain (or half of an Fv comprising only three CDRs specific for a target) can have the ability to recognize and bind target. The reference to a VH-VL dimer herein is not intended to convey any particular configuration. By way of example and not limitation, the VH and VL can come together in any configuration described herein to form a half antibody, or can each be present on a separate half antibody and come together to form an antigen binding domain when the separate half antibodies associate, for example to form a TBM of the disclosure. When present on a single polypeptide chain (e.g., a scFv), the VH and be N-terminal or C-terminal to the VL.

Half Antibody: The term "half antibody" refers to a molecule that comprises at least one ABM or ABM chain and can associate with another molecule comprising an ABM or ABM chain through, e.g., a disulfide bridge or molecular interactions (e.g., knob-in-hole interactions between Fc heterodimers). A half antibody can be composed of one polypeptide chain or more than one polypeptide chains (e.g., the two polypeptide chains of a Fab). In an embodiment, a half-antibody comprises an Fc region.

An example of a half antibody is a molecule comprising a heavy and light chain of an antibody (e.g., an IgG antibody). Another example of a half antibody is a molecule comprising a first polypeptide comprising a VL domain and a CL domain, and a second polypeptide comprising a VH domain, a CH1 domain, a hinge domain, a CH2 domain, and a CH3 domain, where the VL and VH domains form an ABM. Yet another example of a half antibody is a polypeptide comprising an scFv domain, a CH2 domain and a CH3 domain.

A half antibody might include more than one ABM, for example a half-antibody comprising (in N- to C-terminal order) an scFv domain, a CH2 domain, a CH3 domain, and another scFv domain.

Half antibodies might also include an ABM chain that when associated with another ABM chain in another half antibody forms a complete ABM.

Thus, a MBM can comprise one, more typically two, or even more than two half antibodies, and a half antibody can comprise one or more ABMs or ABM chains.

In some MBMs, a first half antibody will associate, e.g., heterodimerize, with a second half antibody. In other MBMs, a first half antibody will be covalently linked to a second half antibody, for example through disulfide bridges or chemical crosslinking. In yet other MBMs, a first half antibody will associate with a second half antibody through both covalent attachments and non-covalent interactions, for example disulfide bridges and knob-in-hole interactions.

The term "half antibody" is intended for descriptive purposes only and does not connote a particular configuration or method of production. Descriptions of a half antibody as a "first" half antibody, a "second" half antibody, a "left" half antibody, a "right" half antibody or the like are merely for convenience and descriptive purposes.

Hexavalent: The term "hexavalent" as used herein in the context of an antigen-binding molecule (e.g., a TBM) refers to an antigen-binding molecule that has six antigen-binding domains. Hexavalent TBMs of the disclosure generally have three pairs of antigen-binding domains that each bind to the same antigen, although different configurations (e.g., three antigen-binding domains, e.g., variant CD58 domains, that bind to CD2, two antigen-binding domains that bind to a component of a TCR complex, and one antigen-binding domain that binds to a TAA, or three antigen-binding domains that bind to CD2, two antigen-binding domains that bind to a TAA, and one antigen-binding domain that binds to a component of a TCR complex) are within the scope of the disclosure. Examples of hexavalent TBMs are shown schematically in FIGS. 2U-2V.

Hole: In the context of a knob-into-hole, a "hole" refers to at least one amino acid side chain which is recessed from the interface of a first Fc chain and is therefore positionable in a compensatory "knob" on the adjacent interfacing surface of a second Fc chain so as to stabilize the Fc heterodimer, and thereby favor Fc heterodimer formation over Fc homodimer formation, for example.

Host cell or recombinant host cell: The terms "host cell" or "recombinant host cell" refer to a cell that has been genetically-engineered, e.g., through introduction of a heterologous nucleic acid. It should be understood that such terms are intended to refer not only to the particular subject cell but to the progeny of such a cell. Because certain modifications can occur in succeeding generations due to either mutation or environmental influences, such progeny may not, in fact, be identical to the parent cell, but are still included within the scope of the term "host cell" as used herein. A host cell can carry the heterologous nucleic acid transiently, e.g., on an extrachromosomal heterologous expression vector, or stably, e.g., through integration of the heterologous nucleic acid into the host cell genome. For purposes of expressing an antigen-binding molecule, a host cell can be a cell line of mammalian origin or mammalian-like characteristics, such as monkey kidney cells (COS, e.g., COS-1, COS-7), HEK293, baby hamster kidney (BHK, e.g., BHK21), Chinese hamster ovary (CHO), NSO, PerC6, BSC-1, human hepatocellular carcinoma cells (e.g., Hep G2), SP2/0, HeLa, Madin-Darby bovine kidney (MDBK), myeloma and lymphoma cells, or derivatives and/or engineered variants thereof. The engineered variants include, e.g., glycan profile modified and/or site-specific integration site derivatives.

Human Antibody: The term "human antibody" as used herein includes antibodies having variable regions in which both the framework and CDR regions are derived from sequences of human origin. Furthermore, if the antibody contains a constant region, the constant region also is derived from such human sequences, e.g., human germline sequences, or mutated versions of human germline sequences or antibody containing consensus framework sequences derived from human framework sequences analysis, for example, as described in Knappik et al., 2000, J Mol Biol 296, 57-86. The structures and locations of immunoglobulin variable domains, e.g., CDRs, can be defined using well known numbering schemes, e.g., the Kabat numbering scheme, the Chothia numbering scheme, or a combination of Kabat and Chothia (see, e.g., Lazikani et al., 1997, J. Mol. Bio. 273:927 948; Kabat et al., 1991, Sequences of Proteins of Immunological Interest, 5th edit., NIH Publication no. 91-3242 U.S. Department of Health and Human Services; Chothia et al., 1987, J. Mol. Biol. 196:901-917; Chothia et al., 1989, Nature 342:877-883).

Human antibodies can include amino acid residues not encoded by human sequences (e.g., mutations introduced by random or site-specific mutagenesis in vitro or by somatic mutation in vivo, or a conservative substitution to promote stability or manufacturing). However, the term "human antibody", as used herein, is not intended to include antibodies in which CDR sequences derived from the germline of another mammalian species, such as a mouse, have been grafted onto human framework sequences.

Humanized: The term "humanized" forms of non-human (e.g., murine) antibodies are chimeric antibodies that contain minimal sequence derived from non-human immunoglobulin. For the most part, humanized antibodies are human immunoglobulins (recipient antibody) in which residues from a hypervariable region of the recipient are replaced by residues from a hypervariable region of a non-human species (donor antibody) such as mouse, rat, rabbit or non-human primate having the desired specificity, affinity, and capacity. In some instances, framework region (FR) residues of the human immunoglobulin are replaced by corresponding non-human residues. Furthermore, humanized antibodies can comprise residues that are not found in the recipient antibody or in the donor antibody. These modifications are made to further refine antibody performance. In general, the humanized antibody will comprise substantially all of at least one, and typically two, variable domains, in which all or substantially all of the hypervariable loops correspond to those of a non-human immunoglobulin and all or substantially all of the FRs are those of a human immunoglobulin lo sequence. The humanized antibody optionally will also comprise at least a portion of an immunoglobulin constant region (Fc), typically that of a human immunoglobulin. For further details, see Jones et al., 1986, Nature 321:522-525; Riechmann et al., 1988, Nature 332:323-329; and Presta, 1992, Curr. Op. Struct. Biol. 2:593-596. See also the following review articles and references cited therein: Vaswani and Hamilton, 1998, Ann. Allergy, Asthma & Immunol. 1:105-115; Harris, 1995, Biochem. Soc. Transactions 23:1035-1038; Hurle and Gross, 1994, Curr. Op. Biotech. 5:428-433.

Knob: In the context of a knob-into-hole, a "knob" refers to at least one amino acid side chain which projects from the interface of a first Fc chain and is therefore positionable in a compensatory "hole" in the interface with a second Fc chain so as to stabilize the Fc heterodimer, and thereby favor Fc heterodimer formation over Fc homodimer formation, for example.

Knobs and holes (or knobs-into-holes): One mechanism for Fc heterodimerization is generally referred to in the art as "knobs and holes", or "knob-in-holes", or "knobs-into-holes". These terms refer to amino acid mutations that create steric influences to favor formation of Fc heterodimers over Fc homodimers, as described in, e.g., Ridgway et al., 1996, Protein Engineering 9(7):617; Atwell et al., 1997, J. Mol. Biol. 270:26; and U.S. Pat. No. 8,216,805. Knob-in-hole mutations can be combined with other strategies to improve heterodimerization, for example as described in Section 7.6.1.6.

Monoclonal Antibody: The term "monoclonal antibody" as used herein refers to polypeptides, including antibodies, antibody fragments, molecules (including MBMs), etc. that are derived from the same genetic source.

Monovalent: The term "monovalent" as used herein in the context of an antigen-binding molecule refers to an antigen-binding molecule that has a single antigen-binding domain.

Multispecific binding molecules: The term "multispecific binding molecules" or "MBMs" refers to molecules that specifically bind to at least two antigens and comprise two or more antigen-binding domains. The antigen-binding domains can each independently be an antibody fragment (e.g., scFv, Fab, nanobody), a ligand, or a non-antibody derived binder (e.g., fibronectin, Fynomer, DARPin).

Mutation or modification: In the context of the primary amino acid sequence of a polypeptide, the terms "modification" and "mutation" refer to an amino acid substitution, insertion, and/or deletion in the polypeptide sequence relative to a reference polypeptide. Additionally, the term "modification" further encompasses an alteration to an amino acid residue, for example by chemical conjugation (e.g., of a drug or polyethylene glycol moiety) or post-translational modification (e.g., glycosylation).

Nucleic Acid: The term "nucleic acid" is used herein interchangeably with the term "polynucleotide" and refers to deoxyribonucleotides or ribonucleotides and polymers thereof in either single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, and peptide-nucleic acids (PNAs).

Unless otherwise indicated, a particular nucleic acid sequence also implicitly encompasses conservatively modified variants thereof (e.g., degenerate codon substitutions) and complementary sequences, as well as the sequence explicitly indicated. Specifically, as detailed below, degenerate codon substitutions can be achieved by generating sequences in which the third position of one or more selected (or all) codons is substituted with mixed-base and/or deoxyinosine residues (Batzer et al., 1991, Nucleic Acid Res. 19:5081; Ohtsuka et al., 1985, J. Biol. Chem. 260: 2605-2608; and Rossolini et al., 1994, Mol. Cell. Probes 8:91-98).

Operably linked: The term "operably linked" refers to a functional relationship between two or more peptide or polypeptide domains or nucleic acid (e.g., DNA) segments. In the context of a fusion protein or other polypeptide, the term "operably linked" means that two or more amino acid segments are linked so as to produce a functional polypeptide. For example, in the context of an antigen-binding molecule, separate ABMs (or chains of an ABM) can be operably linked through peptide linker sequences. In the context of a nucleic acid encoding a fusion protein, such as a polypeptide chain of an antigen-binding molecule, "operably linked" means that the two nucleic acids are joined such that the amino acid sequences encoded by the two nucleic acids remain in-frame. In the context of transcriptional regulation, the term refers to the functional relationship of a transcriptional regulatory sequence to a transcribed sequence. For example, a promoter or enhancer sequence is operably linked to a coding sequence if it stimulates or modulates the transcription of the coding sequence in an appropriate host cell or other expression system.

Pentavalent: The term "pentavalent" as used herein in the context of an antigen-binding molecule (e.g., a TBM) refers to an antigen-binding molecule that has five antigen-binding domains. Pentavalent TBMs of the disclosure generally have either (a) two pairs of antigen-binding domains that each bind to the same antigen and a single antigen-binding domain that binds to the third antigen or (b) three antigen-binding domains that bind to the same antigen and two antigen-binding domains that each bind to a separate antigen. An example of a pentavalent TBM is shown schematically in FIG. 1T.

Polypeptide and Protein: The terms "polypeptide" and "protein" are used interchangeably herein to refer to a polymer of amino acid residues. The terms encompass amino acid polymers in which one or more amino acid residue is an artificial chemical mimetic of a corresponding naturally occurring amino acid, as well as to naturally occurring amino acid polymers and non-naturally occurring amino acid polymer. Additionally, the terms encompass amino acid polymers that are derivatized, for example, by synthetic derivatization of one or more side chains or termini, glycosylation, PEGylation, circular permutation, cyclization, linkers to other molecules, fusion to proteins or protein domains, and addition of peptide tags or labels.

Recognize: The term "recognize" as used herein refers to an ABM that finds and interacts (e.g., binds) with its epitope.

Sequence identity: Sequence identity between two similar sequences (e.g., antibody variable domains) can be measured by algorithms such as that of Smith, T. F. & Waterman, M. S. (1981) "Comparison Of Biosequences," Adv. Appl. Math. 2:482 [local homology algorithm]; Needleman, S. B. & Wunsch, C D. (1970) "A General Method Applicable To The Search For Similarities In The Amino Acid Sequence Of Two Proteins," J. Mol. Biol. 48:443 [homology alignment algorithm], Pearson, W. R. & Lipman, D. J. (1988) "Improved Tools For Biological Sequence Comparison," Proc. Natl. Acad. Sci. (U.S.A.) 85:2444 [search for similarity method]; or Altschul, S. F. et al, 1990, "Basic Local Alignment Search Tool," J. Mol. Biol. 215:403-10, the "BLAST" algorithm, see blast.ncbi.nlm.nih.gov/Blast.cgi. When using any of the aforementioned algorithms, the default parameters (for Window length, gap penalty, etc.) are used. In one embodiment, sequence identity is done using the BLAST algorithm, using default parameters.

Optionally, the identity is determined over a region that is at least about 50 nucleotides (or, in the case of a peptide or polypeptide, at least about 10 amino acids) in length, or in some cases over a region that is 100 to 500 or 1000 or more nucleotides (or 20, 50, 200 or more amino acids) in length. In some embodiments, the identity is determined over a defined domain, e.g., the VH or VL of an antibody. Unless specified otherwise, the sequence identity between two sequences is determined over the entire length of the shorter of the two sequences.

Single Chain Fab or scFab: The terms "single chain Fab" and "scFab" mean a polypeptide comprising an antibody heavy chain variable domain (VH), an antibody constant domain 1 (CH1), an antibody light chain variable domain (VL), an antibody light chain constant domain (CL) and a linker, such that the VH and VL are in association with one another and the CH1 and CL are in association with one another. In some embodiments, the antibody domains and the linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL. The linker can be a polypeptide of at least 30 amino acids, for example between 32 and 50 amino acids. The single chain Fabs are stabilized via the natural disulfide bond between the CL domain and the CH1 domain.

Single Chain Fv or scFv: The term "single-chain Fv" or "scFv" as used herein refers to antibody fragments that comprise the VH and VL domains of an antibody, where these domains are present in a single polypeptide chain. The Fv polypeptide can further comprise a polypeptide linker between the VH and VL domains which enables the scFv to form the desired structure for antigen-binding. For a review of scFv see Pluckthun in The Pharmacology of Monoclonal Antibodies, vol. 113, Rosenburg and Moore eds., 1994, Springer-Verlag, New York, pp. 269-315.

Specifically (or selectively) binds: The term "specifically (or selectively) binds" to an antigen or an epitope refers to a binding reaction that is determinative of the presence of a cognate antigen or an epitope in a heterogeneous population of proteins and other biologics. The binding reaction can be but need not be mediated by an antibody or antibody fragment, but can also be mediated by, for example, any type of ABM described in 7.5, such as a ligand, a DARPin, etc. An ABM typically also has a dissociation rate constant (KD) (koff/kon) of less than $5\times10^{-2}$M, less than $10^{-2}$M, less than $5\times10^{-3}$M, less than $10^{-3}$M, less than $5\times10^{-4}$M, less than $10^{-4}$M, less than $5\times10^{-5}$M, less than $10^{-5}$M, less than $5\times10^{-6}$M, less than $10^{-6}$M, less than $5\times10^{-7}$M, less than $10^{-7}$M, less than $5\times10^{-8}$M, less than $10^{-8}$M, less than $5\times10^{-9}$M, or less than $10^{-9}$M, and binds to the target antigen with an affinity that is at least two-fold greater than its affinity for binding to a non-specific antigen (e.g., HSA). Binding affinity can be measured using a Biacore, SPR or BLI assay. The term "specifically binds" does not exclude cross-species reactivity. For example, an antigen-binding module (e.g., an antigen-binding fragment of an antibody) that "specifically binds" to an antigen from one species can also "specifically bind" to that antigen in one or more other species. Thus, such cross-species reactivity does not itself alter the classification of an antigen-binding module as a "specific" binder. In certain embodiments, an antigen-binding module that specifically binds to a human antigen has cross-species reactivity with one or more non-human mammalian species, e.g., a primate species (including but not limited to one or more of *Macaca fascicularis, Macaca mulatta,* and *Macaca nemestrina*) or a rodent species, e.g., *Mus musculus.* In other embodiments, the antigen-binding module does not have cross-species reactivity.

Subject: The term "subject" includes human and non-human animals. Non-human animals include all vertebrates, e.g., mammals and non-mammals, such as non-human primates, sheep, dog, cow, chickens, amphibians, and reptiles. Except when noted, the terms "patient" or "subject" are used herein interchangeably.

Tandem of VH Domains: The term "a tandem of VH domains (or VHs)" as used herein refers to a string of VH domains, consisting of multiple numbers of identical VH domains of an antibody. Each of the VH domains, except the last one at the end of the tandem, has its C-terminus connected to the N-terminus of another VH domain with or without a linker. A tandem has at least 2 VH domains, and in particular embodiments an antigen-binding molecule has 3, 4, 5, 6, 7, 8, 9, or 10 VH domains. The tandem of VH can be produced by joining the encoding nucleic acids of each VH domain in a desired order using recombinant methods with or without a linker (e.g., as described in Section 7.6.3) that enables them to be made as a single polypeptide chain. The N-terminus of the first VH domain in the tandem is defined as the N-terminus of the tandem, while the C-terminus of the last VH domain in the tandem is defined as the C-terminus of the tandem.

Tandem of VL Domains: The term "a tandem of VL domains (or VLs)" as used herein refers to a string of VL domains, consisting of multiple numbers of identical VL domains of an antibody. Each of the VL domains, except the last one at the end of the tandem, has its C-terminus connected to the N-terminus of another VL with or without a linker. A tandem has at least 2 VL domains, and in particular embodiments an antigen-binding molecule has 3, 4, 5, 6, 7, 8, 9, or 10 VL domains. The tandem of VL can be produced by joining the encoding nucleic acids of each VL domain in a desired order using recombinant methods with or without a linker (e.g., as described in Section 7.6.3) that enables them to be made as a single polypeptide chain. The N-terminus of the first VL domain in the tandem is defined as the N-terminus of the tandem, while the C-terminus of the last VL domain in the tandem is defined as the C-terminus of the tandem.

Target Antigen: By "target antigen" as used herein is meant the molecule that is bound non-covalently, reversibly and specifically by an antigen binding domain.

Tetravalent: The term "tetravalent" as used herein in the context of an antigen-binding molecule (e.g., a BBM or TBM) refers to an antigen-binding molecule that has four antigen-binding domains. Tetravalent TBMs of the disclosure generally have two antigen-binding domains that bind to the same antigen (e.g., CD2) and two antigen-binding domains that each bind to a separate antigen (e.g., a component of a TCR complex and a TAA). Examples of tetravalent BBMs are shown schematically in FIGS. 1AA-1AH and examples of tetravalent TBMs are shown schematically in FIGS. 2Q-2S.

Therapeutically effective amount: A "therapeutically effective amount" refers to an amount effective, at dosages and for periods of time necessary, to achieve a desired therapeutic result.

Treat, Treatment, Treating: As used herein, the terms "treat", "treatment" and "treating" refer to the reduction or amelioration of the progression, severity and/or duration of a disease or disorder (e.g., a proliferative disorder), or the amelioration of one or more symptoms (e.g., one or more discernible symptoms) of a disorder resulting from the administration of one or more CD2 binding molecules of the disclosure. In some embodiments, the terms "treat", "treatment" and "treating" refer to the amelioration of at least one measurable physical parameter of a disorder, such as growth of a tumor, not necessarily discernible by the patient. In other embodiments the terms "treat", "treatment" and "treating" refer to the inhibition of the progression of a disorder, either physically by, e.g., stabilization of a discernible symptom, physiologically by, e.g., stabilization of a physical parameter, or both. In some embodiments, the terms "treat", "treatment" and "treating" can refer to the reduction or stabilization of tumor size or cancerous cell count.

Trispecific binding molecules: The term "trispecific binding molecules" or "TBMs" refers to molecules that specifically bind to three antigens and comprise three or more antigen-binding domains. The TBMs of the disclosure comprise at least one antigen-binding domain, e.g., a variant CD58 domain, which is specific for CD2, at least one antigen-binding domain which is specific for a component of a TCR complex or a TAA, and at least one antigen-binding domain which is specific for a TAA or a second TAA. The antigen-binding domains can each independently be an antibody fragment (e.g., scFv, Fab, nanobody), a ligand, or a non-antibody derived binder (e.g., fibronectin, Fynomer, DARPin). Representative TBMs are illustrated in FIG. 1. TBMs can comprise one, two, three, four or even more polypeptide chains. For example, the TBM illustrated in FIG. 1M comprises a single polypeptide chain comprising three scFvs connected by ABM linkers one a single polypeptide chain. The TBM illustrated in FIG. 1K comprises two polypeptide chains comprising three scFvs connected by, inter alia, an Fc domain. The TBM illustrated in FIG. 1J comprises three polypeptide chains forming an scFv, a ligand, and a Fab connected by, inter alia, an Fc domain. The TBM illustrated in FIG. 1C comprises four polypeptide chains forming three Fabs connected by, inter alia, an Fc domain. The TBM illustrated in FIG. 1U comprises 6 polypeptide chains forming four Fabs and two scFvs connected by, inter alia, an Fc domain. In the TBMs of the disclosure, a variant CD58 domain can substitute for a Fab and/or scFv in any of the configurations illustrated.

Trivalent: The term "trivalent" as used herein in the context of an antigen-binding molecule (e.g., a MBM) refers to an antigen-binding molecule that has three antigen-binding domains. Typically, bispecific BBMs specifically bind to CD2 and a component of a TCR complex or a TAA and trispecific TBMs specifically bind to CD2 (by virtue of a variant CD58 domain), a component of a TCR complex or a TAA, and a TAA or a second TAA. Accordingly, the trivalent BBMs have three antigen binding domains, two of which bind to CD2 and one of which binds to, for example, a component of the TCR, or vice versa. TBMs have three antigen-binding domains that each bind to a different antigen. Examples of trivalent BBMs are shown schematically in FIGS. 1G-1Z and examples of trivalent TBMs are shown schematically in FIGS. 2B-2V.

Tumor: The term "tumor" is used interchangeably with the term "cancer" herein, e.g., both terms encompass solid and liquid, e.g., diffuse or circulating, tumors. As used herein, the term "cancer" or "tumor" includes premalignant, as well as malignant cancers and tumors.

Tumor-Associated Antigen: The term "tumor-associated antigen" or "TAA" refers to a molecule (typically a protein, carbohydrate, lipid or some combination thereof) that is expressed on the surface of a cancer cell, either entirely or as a fragment (e.g., MHC/peptide), and which is useful for the preferential targeting of a pharmacological agent to the cancer cell. In some embodiments, a TAA is a marker expressed by both normal cells and cancer cells, e.g., a lineage marker, e.g., CD19 on B cells. In some embodiments, a TAA is a cell surface molecule that is overexpressed in a cancer cell in comparison to a normal cell, for instance, 1-fold over expression, 2-fold overexpression, 3-fold overexpression or more in comparison to a normal cell. In some embodiments, a TAA is a cell surface molecule that is inappropriately synthesized in the cancer cell, for instance, a molecule that contains deletions, additions or mutations in comparison to the molecule expressed on a normal cell. In some embodiments, a TAA will be expressed exclusively on the cell surface of a cancer cell, entirely or as a fragment (e.g., MHC/peptide), and not synthesized or expressed on the surface of a normal cell. Accordingly, the term "TAA" encompasses antigens that are specific to cancer cells, sometimes referred to as tumor-specific antigens ("TSAs").

Trivalent: The term "trivalent" as used herein in the context of an antigen-binding molecule (e.g., a BBM) refers to an antigen-binding molecule that has three ABMs. Antigen-binding molecules of the disclosure that are BBMs are bispecific and specifically bind to CD2 (by virtue of a variant CD58 domain) and a second antigen, e.g., a component of a TCR complex. Accordingly, the trivalent BBMs have two ABMs that bind to one antigen (e.g., CD2) and one ABM that binds to a different antigen (e.g., a component of the TCR complex). Examples of trivalent configurations are shown schematically in FIGS. 1G-1Z. In the BBMs and TBMs of the disclosure, a variant CD58 domain can substitute for a Fab and/or scFv in any of the configurations illustrated.

Variable region: By "variable region" or "variable domain" as used herein is meant the region of an immunoglobulin that comprises one or more Ig domains substantially encoded by any of the Vκ, VΔ, and/or VH genes that make up the kappa, lambda, and heavy chain immunoglobulin genetic loci respectively, and contains the CDRs that confer antigen specificity. A "variable heavy domain" can pair with a "variable light domain" to form an antigen binding domain ("ABD") or antigen-binding module ("ABM"). In addition, each variable domain comprises three hypervariable regions ("complementary determining regions," "CDRs") (CDR-H1, CDR-H2, CDR-H3 for the variable heavy domain and CDR-L1, CDR-L2, CDR-L3 for the variable light domain) and four framework (FR) regions, arranged from amino-terminus to carboxy-terminus in the following order: FR1-CDR1-FR2-CDR2-FR3-CDR3-FR4.

Vector: The term "vector" is intended to refer to a polynucleotide molecule capable of transporting another polynucleotide to which it has been linked. One type of vector is a "plasmid", which refers to a circular double stranded DNA loop into which additional DNA segments can be ligated. Another type of vector is a viral vector, where additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operably linked. Such vectors are referred to herein as "recombinant expression vectors" (or simply, "expression vectors"). In general, expression vectors of utility in recombinant DNA techniques are often in the form of plasmids. In the present specification, "plasmid" and "vector" can be used interchangeably as the plasmid is the most commonly used form of vector. However, the disclosure is intended to include such other forms of expression vectors, such as viral vectors (e.g., replication defective retroviruses, adenoviruses and adeno-associated viruses), which serve equivalent functions.

VH: The term "VH" refers to the variable region of an immunoglobulin heavy chain of an antibody, including the heavy chain of an Fv, scFv, dsFv or Fab.

VL: The term "VL" refers to the variable region of an immunoglobulin light chain, including the light chain of an Fv, scFv, dsFv or Fab.

VH-VL or VH-VL Pair: In reference to a VH-VL pair, whether on the same polypeptide chain or on different polypeptide chains, the terms "VH-VL" and "VH-VL pair" are used for convenience and are not intended to convey any particular orientation, unless the context dictates otherwise. Thus, a scFv comprising a "VH-VL" or "VH-VL pair" can have the VH and VL domains in any orientation, for example the VH N-terminal to the VL or the VL N-terminal to the VH.

7.2. CD2 Binding Molecules

The present disclosure relates to CD2 binding molecules that comprise a variant CD58 domain as described in Section 7.3. Optionally, the CD2 binding molecules can be multispecific and include one or more antigen binding modules (ABMs) that bind to other target molecules, for example as described in Section 7.5.

The CD2 binding molecules can be fused or chemically conjugated (including both covalent and non-covalent conjugations) to a heterologous protein or polypeptide (or fragment thereof, for example to a polypeptide of at least 10, at least 20, at least 30, at least 40, at least 50, at least 60, at least 70, at least 80, at least 90 or at least 100 amino acids). For example, a CD2 binding molecule can be fused directly or indirectly to a detectable protein, e.g., an enzyme or a fluorescent protein such as those described in Section 7.14. Methods for fusing or conjugating proteins, polypeptides, or peptides to an antibody or an antibody fragment are known and can be used to fuse or conjugate a protein or polypeptide to a CD2 binding molecule of the disclosure. See, e.g., U.S. Pat. Nos. 5,336,603, 5,622,929, 5,359,046, 5,349,053, 5,447,851, and 5,112,946; European Patent Nos. EP 307,434 and EP 367,166; International Publication Nos. WO 96/04388 and WO 91/06570; Ashkenazi et al., 1991, Proc. Natl. Acad. Sci. USA 88:10535-10539; Zheng et al., 1995, J. Immunol. 154:5590-5600; and Vil et al., 1992, Proc. Natl. Acad. Sci. USA 89:11337-11341.

Exemplary fusion proteins are Ig fusions comprising the variant CD58 domains of the disclosure, as described in Section 7.4.

Additional CD2 binding molecules can be generated through the techniques of gene-shuffling, motif-shuffling, exon-shuffling, and/or codon-shuffling (collectively referred to as "DNA shuffling"). DNA shuffling can be employed to alter the activities of molecules of the disclosure or fragments thereof (e.g., molecules or fragments thereof with higher affinities and lower dissociation rates). See, generally, U.S. Pat. Nos. 5,605,793, 5,811,238, 5,830,721, 5,834,252, and 5,837,458; Patten et al., 1997, Curr. Opinion Biotechnol. 8:724-33; Harayama, 1998, Trends Biotechnol. 16(2):76-82; Hansson et al., 1999, J. Mol. Biol. 287:265-76; and Lorenzo and Blasco, 1998, Biotechniques 24(2):308-313. The CD2 binding molecules described herein or fragments thereof can be altered by being subjected to random mutagenesis by error-prone PCR, random nucleotide insertion or other methods prior to recombination. A polynucleotide encoding a fragment of a CD2 binding molecule described herein can be recombined with one or more components, motifs, sections, parts, domains, fragments, etc. of one or more heterologous molecules.

Moreover, CD2 binding molecules can be fused to marker sequences, such as a peptide to facilitate purification. In some embodiments, the marker amino acid sequence is a hexa-histidine peptide (SEQ ID NO: 716), such as the tag provided in a pQE vector (QIAGEN, Inc., 9259 Eton Avenue, Chatsworth, CA, 91311), among others, many of which are commercially available. As described in Gentz et al., 1989, Proc. Natl. Acad. Sci. USA 86:821-824, for instance, hexa-histidine (SEQ ID NO: 716) provides for convenient purification of the fusion protein. Other peptide tags useful for purification include, but are not limited to, the hemagglutinin ("HA") tag, which corresponds to an epitope derived from the influenza hemagglutinin protein (Wilson et al., 1984 Cell 37:767), and the "flag" tag.

7.3. Variant CD58 Domains

CD58, also known as LFA-3, is the natural ligand for CD2. CD58/LFA-3 proteins are glycoproteins that are expressed on the surfaces of a variety of cell types (Dustin et al., 1991, Annu. Rev. Immunol. 9:27) and play roles in mediating T-cell interactions with APCs in both antigen-dependent and antigen-independent manners (Wallner et al., 1987, J. Exp. Med. 166:923).

The sequence of human CD58 has the Uniprot identifier P19256 (www.uniprot.org/uniprot/P19256). The extracellular region of human CD58 comprises two Ig-like domains. The most N-terminal Ig-like domain, referred to as domain 1, is of V-type, and the second Ig-like domain, named domain 2, is of C-type. As schematic overview of the CD58 domains is illustrated in FIG. 14.

The interactions between CD58 and CD2 have been mapped through x-ray crystallography and molecular modeling and occur through domain 1, the Ig-V domain, of CD58. See, e.g., Ikemizu et al., 1999, Proc. Natl. Acad. Sci. USA 96:4289-94; Sun et al., 1999, EMBO J. 18(11): 2941-2949; and Wang et al., 1999, Cell 97(6):791-803.

The CD58 variants provided by the present disclosure comprise a domain 1 that has been engineered to include a pair of cysteine substitutions that upon recombinant expression create a disulfide bridge. Without being bound by theory, it is believed that the introduction of disulfide bridges improves the stability (e.g., thermostability) of CD58, which is advantageous for manufacturing a therapeutic molecule with improved storage characteristics, without impairing the ability of domain 1 to bind to CD2. Exemplary amino acid pairs that can be substituted with cysteines in order to form a disulfide bridge upon expression (with numbering referring to the full length polypeptide) are (a) a V45C substitution and a M105C substitution; (b) a V54C substitution and a G88C substitution; (c) a V45C substitution and a M114C substitution; and (d) a W56C substitution and a L900 substitution.

The CD58 variants can also include other substitutions, for example substitutions that do not significantly reduce binding to CD2. The following substitutions (with numbering referring to the full length polypeptide) did not impact binding to CD2: F29S; V37K; V49Q; V86K; T113S; and L121G. Ikemizu et al., 1999, Proc. Natl. Acad. Sci. USA 96:4289-94. Accordingly, a CD58 moiety can include one, two, three, four, five or all six of the foregoing substitutions.

In contrast, substitution of residues E25, K29, K30, K32, D33, K34, E37, D84 and K87 (with numbering referring to the in the mature polypeptide) can reduce binding to CD2. Ikemizu et al., 1999, Proc. Natl. Acad. Sci. USA 96:4289-94. Accordingly, in some embodiments the CD58 domain retains the wild type residues at E25, K29, K30, K32, D33, K34, E37, D84 and K87.

Sequences CD58-1 through CD58-7 in Table 1 are wild type CD58 sequences (full length, extracellular domain, and Ig-V domain (domain 1) and optionally contain the substitutions disclosed in Ikemizu et al., 1999, Proc. Natl. Acad. Sci. USA 96:4289-94. Sequences CD58-8 through CD58-11 in Table 1 are wild type Ig-V domains engineered to include a cysteine pair as described herein.

TABLE 1

CD58 sequences

| Name | Description | Sequence | SEQ ID NO: |
|---|---|---|---|
| CD58-1 | Full length CD58, including signal sequence and full intracellular domain (P19256) | MVAGSDAGRALGVLSVVCLLHCFGFISCFSQQIYGVVY GNVTFHVPSNVPLKEVLWKKQKDKVAELENSEFRAFS SFKNRVYLDTVSGSLTIYNLTSSDEDEYEMESPNITDTM KFFLYVLESLPSPTLTCALTNGSIEVQCMIPEHYNSHRG LIMYSWDCPMEQCKRNSTSIYFKMENDLPQKIQCTLSN PLFNTTSSIILTTCIPSSGHSRHRYALIPIPLAVITTCIVLY MNGILKCDRKPDRTNSN' | 1 |
| CD58-2 | Full length CD58, including signal sequence and but no intracellular domain (P19256-2) | MVAGSDAGRALGVLSVVCLLHCFGFISCFSQQIYGVVY GNVTFHVPSNVPLKEVLWKKQKDKVAELENSEFRAFS SFKNRVYLDTVSGSLTIYNLTSSDEDEYEMESPNITDTM KFFLYVLESLPSPTLTCALTNGSIEVQCMIPEHYNSHRG LIMYSWDCPMEQCKRNSTSIYFKMENDLPQKIQCTLSN PLFNTTSSIILTTCIPSSGHSRHRYALIPIPLAVITTCIVLY MNVL | 2 |

TABLE 1-continued

CD58 sequences

| Name | Description | Sequence | SEQ ID NO: |
|---|---|---|---|
| CD58-3 | Full length CD58, including signal sequence and variant intracellular domain (P19256-3) | MVAGSDAGRALGVLSVVCLLHCFGFISCFSQQIYGVVY<br>GNVTFHVPSNVPLKEVLWKKQKDKVAELENSEFRAFS<br>SFKNRVYLDTVSGSLTIYNLTSSDEDEYEMESPNITDTM<br>KFFLYVLESLPSPTLTCALTNGSIEVQCMIPEHYNSHRG<br>LIMYSWDCPMEQCKRNSTSIYFKMENDLPQKIQCTLSN<br>PLFNTTSSIILTTCIPSSGHSRHRYALIPIPLAVITTCIVLY<br>MNGILKCDRKPDRTK | 3 |
| CD58-4 | Extracellular domain of CD58, corresponding to amino acids 29-215 of CD58 (WT) | FSQQIYGVVYGNVTFHVPSNVPLKEVLWKKQKDKVAE<br>LENSEFRAFSSFKNRVYLDTVSGSLTIYNLTSSDEDEYE<br>MESPNITDTMKFFLYVLESLPSPTLTCALTNGSIEVQCM<br>IPEHYNSHRGLIMYSWDCPMEQCKRNSTSIYFKMENDL<br>PQKIQCTLSNPLFNTTSSIILTTCIPSSGHSRHR | 4 |
| CD58-5 | Extracellular domain of CD58, corresponding to amino acids 29-215 of CD58 (with permitted substitutions) | BSQQIYGVJYGNVTFHVPSNOPLKEVLWKKQKDK<br>VAELENSEFRAFSSFKNRVYLDTUSGSLTIYNLTS<br>SDEDEYEMESPNITDXMKFFLYVZESLPSPTLTCA<br>LTNGSIEVQCMIPEHYNSHRGLIMYSWDCPMEQC<br>KRNSTSIYFKMENDLPQKIQCTLSNPLFNTTSSIILT<br>TCIPSSGHSRHR<br>B = F or S<br>J = V or K<br>O = V or Q<br>U = V or K<br>X = T or S<br>Z = L or G | 5 |
| CD58-6 | Amino acids 30-123 (WT) Ig-V like domain | SQQIYGVVYGNVTFHVPSNVPLKEVLWKKQKDKVAEL<br>ENSEFRAFSSFKNRVYLDTVSGSLTIYNLTSSDEDEYE<br>MESPNITDTMKFFLYVLES | 6 |
| CD58-7 | Amino acids 30-123 (with permitted substitutions) Ig-V like domain | SQQIYGVJYGNVTFHVPSNOPLKEVLWKKQKDKVAEL<br>ENSEFRAFSSFKNRVYLDTVSGSLTIYNLTSSDEDEYE<br>MESPNITDTMKFFLYVLES<br>J = V or K<br>O = V or Q | 7 |
| CD58-8 | Amino acids 30-123 (V45C_M105C) Ig-V like domain | SQQIYGVVYGNVTFHCPSNVPLKEVLWKKQKDKVAEL<br>ENSEFRAFSSFKNRVYLDTVSGSLTIYNLTSSDEDEYE<br>CESPNITDTMKFFLYVLES | 8 |
| CD58-9 | Amino acids 30-123 (V54C_G88C) Ig-V like domain | SQQIYGVVYGNVTFHVPSNVPLKECLWKKQKDKVAEL<br>ENSEFRAFSSFKNRVYLDTVSCSLTIYNLTSSDEDEYE<br>MESPNITDTMKFFLYVLES | 9 |
| CD58-10 | Amino acids 30-123 (V45C_M114C) Ig-V like domain | SQQIYGVVYGNVTFHCPSNVPLKEVLWKKQKDKVAEL<br>ENSEFRAFSSFKNRVYLDTVSGSLTIYNLTSSDEDEYE<br>MESPNITDTCKFFLYVLES | 10 |
| CD58-11 | Amino acids 30-123 (W56C_L90C) Ig-V like domain | SQQIYGVVYGNVTFHVPSNVPLKEVLCKKQKDKVAELE<br>NSEFRAFSSFKNRVYLDTVSGSCTIYNLTSSDEDEYEM<br>ESPNITDTMKFFLYVLES | 11 |

The CD58 domains of the disclosure comprises an amino acid sequence comprising at least 70% sequence identity to a CD2-binding portion of CD58, e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to a CD2-binding portion of CD58, together with at least one pair of cysteine substitutions, such as a V45C+M105C; V54C+G88C; V45C+M114C; or W56C+L900 (amino acid numbering based on the full length CD58 protein).

It has been established that CD58 fragments containing amino acid residues 30-123 of full length CD58 (i.e., the sequence designated as CD58-6 in Table 1 above) are sufficient for binding to CD2. Wang et al., 1999, Cell 97:791-803. Accordingly, in certain aspects, a CD58 moiety comprises an amino acid sequence comprising at least 70% sequence identity to amino acids 30-123 of CD58, e.g., at least 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% identity to the amino acid sequence designated CD58-6 and contain at least one pair of cysteine substitutions, such as a V45C+M105C; V54C+G88C; V45C+M114C; or W56C+L900 (amino acid numbering based on the full length CD58 protein).

7.4. Ig Fusion Proteins

In certain aspects of the disclosure, the variant CD58 domains of the disclosure are in the form of Ig fusion proteins, for example an Ig fusion protein comprising an Fc region in addition to the variant CD58 domain.

In some embodiment, the Fc portion of an Ig fusion protein is a native Fc region. Exemplary Fc regions are IgG1, IgG2, IgG3, and IgG4 Fc regions.

In other embodiments, the Fc region is a variant Fc region.

In some aspects, the variant Fc region enhances affinity to the neonatal Fc receptor FcRn and/or extends half-life of the Ig fusion protein in vivo. Exemplary variants for enhancing FcRn affinity and/or extending half-life in vivo include but are not limited to 259I, 307Q, 308F, 311I, 311V, 378V, 378T, 426V, 428L, 434S, 436I, 436V, 250Q, 434A, 252Y, 254T, and 256E, wherein numbering is according to the EU index. In a particular embodiment, the variant comprises the amino acid substitution(s) 428L and/or 434S, wherein numbering is according to the EU index.

Other exemplary Fc sequences are described in Section 7.6.1

7.5. Multispecific Binding Molecules

The CD2 binding molecules of the disclosure can be multispecific, i.e., they can contain additional binding modules other than the CD2 ABM. For example, the CD2 binding molecules of the disclosure can be a bispecific binding molecule with a second ABM ("ABM2"), or a trispecific binding molecule with an ABM2 and a third ABM ("ABM3"), etc.

In some embodiments, ABM2 and/or ABM3 (when present), are chimeric or humanized monoclonal antibodies. Chimeric and/or humanized antibodies, can be engineered to minimize the immune response by a human patient to antibodies produced in non-human subjects or derived from the expression of non-human antibody genes. Chimeric antibodies comprise a non-human animal antibody variable region and a human antibody constant region. Such antibodies retain the epitope binding specificity of the original monoclonal antibody, but can be less immunogenic when administered to humans, and therefore more likely to be tolerated by the patient. For example, one or all (e.g., one, two, or three) of the variable regions of the light chain(s) and/or one or all (e.g., one, two, or three) of the variable regions the heavy chain(s) of a mouse antibody (e.g., a mouse monoclonal antibody) can each be joined to a human constant region, such as, without limitation an IgG1 human constant region. Chimeric monoclonal antibodies can be produced by known recombinant DNA techniques. For example, a gene encoding the constant region of a non-human antibody molecule can be substituted with a gene encoding a human constant region (see Robinson et al., PCT Patent Publication PCT/US86/02269; Akira, et al., European Patent Application 184,187; or Taniguchi, M., European Patent Application 171,496). In addition, other suitable techniques that can be used to generate chimeric antibodies are described, for example, in U.S. Pat. Nos. 4,816,567; 4,978,775; 4,975,369; and 4,816,397.

Chimeric or humanized antibodies and antigen binding fragments thereof of the present disclosure can be prepared based on the sequence of a murine monoclonal antibody. DNA encoding the heavy and light chain immunoglobulins can be obtained from a murine hybridoma of interest and engineered to contain non-murine (e.g., human) immunoglobulin sequences using standard molecular biology techniques. For example, to create a chimeric antibody, the murine variable regions can be linked to human constant regions using known methods (see e.g., U.S. Pat. No. 4,816,567 to Cabilly et al.). To create a humanized antibody, the murine CDR regions can be inserted into a human framework using known methods. See e.g., U.S. Pat. No. 5,225,539 to Winter, and U.S. Pat. Nos. 5,530,101; 5,585,089; 5,693,762 and 6,180,370 to Queen et al.

A humanized antibody can be produced using a variety of known techniques, including but not limited to, CDR-grafting (see, e.g., European Patent No. EP 239,400; International Publication No. WO 91/09967; and U.S. Pat. Nos. 5,225,539, 5,530,101, and 5,585,089), veneering or resurfacing (see, e.g., European Patent Nos. EP 592,106 and EP 519,596; Padlan, 1991, Molecular Immunology, 28(4/5): 489-498; Studnicka et al., 1994, Protein Engineering, 7(6): 805-814; and Roguska et al., 1994, PNAS, 91:969-973), chain shuffling (see, e.g., U.S. Pat. No. 5,565,332), and techniques disclosed in, e.g., U.S. Patent Application Publication No. US2005/0042664, U.S. Patent Application Publication No. US2005/0048617, U.S. Pat. Nos. 6,407,213, 5,766,886, International Publication No. WO 9317105, Tan et al., J. Immunol., 169:1119-25 (2002), Caldas et al., Protein Eng., 13(5):353-60 (2000), Morea et al., Methods, 20(3):267-79 (2000), Baca et al., J. Biol. Chem., 272(16): 10678-84 (1997), Roguska et al., Protein Eng., 9(10):895-904 (1996), Couto et al., Cancer Res., 55 (23 Supp):5973s-5977s (1995), Couto et al., Cancer Res., 55(8):1717-22 (1995), Sandhu J S, Gene, 150(2):409-10 (1994), and Pedersen et al., J. Mol. Biol., 235(3):959-73 (1994). Often, framework residues in the framework regions will be substituted with the corresponding residue from the CDR donor antibody to alter, for example improve, antigen binding. These framework substitutions, e.g., conservative substitutions are identified by known methods, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; and Riechmann et al., 1988, Nature, 332:323).

As provided herein, humanized antibodies or antibody fragments can comprise one or more CDRs from nonhuman immunoglobulin molecules and framework regions where the amino acid residues comprising the framework are derived completely or mostly from human germline. Multiple techniques for humanization of antibodies or antibody fragments are well-known and can essentially be performed following the method of Winter and co-workers (Jones et al., Nature, 321:522-525 (1986); Riechmann et al., Nature, 332:323-327 (1988); Verhoeyen et al., Science, 239:1534-1536 (1988)), by substituting rodent CDRs or CDR sequences for the corresponding sequences of a human antibody, i.e., CDR-grafting (EP 239,400; PCT Publication No. WO 91/09967; and U.S. Pat. Nos. 4,816,567; 6,331,415; 5,225,539; 5,530,101; 5,585,089; 6,548,640). In such humanized antibodies and antibody fragments, substantially less than an intact human variable domain has been substituted by the corresponding sequence from a nonhuman species. Humanized antibodies are often human antibodies in which some CDR residues and possibly some framework (FR) residues are substituted by residues from analogous sites in rodent antibodies. Humanization of antibodies and antibody fragments can also be achieved by veneering or resurfacing (EP 592,106; EP 519,596; Padlan, 1991, Molecular Immunology, 28(4/5):489-498; Studnicka et al., Protein Engineering, 7(6):805-814 (1994); and Roguska et al., PNAS, 91:969-973 (1994)) or chain shuffling (U.S. Pat. No. 5,565,332).

The choice of human variable domains, both light and heavy, to be used in making the humanized antibodies is to reduce antigenicity. According to the so-called "best-fit" method, the sequence of the variable domain of a rodent antibody is screened against the entire library of known human variable-domain sequences. The human sequence which is closest to that of the rodent is then accepted as the human framework (FR) for the humanized antibody (Sims et al., J. Immunol., 151:2296 (1993); Chothia et al., J. Mol. Biol., 196:901 (1987)). Another method uses a particular framework derived from the consensus sequence of all human antibodies of a particular subgroup of light or heavy chains. The same framework can be used for several different humanized antibodies (see, e.g., Nicholson et al. Mol. Immun. 34 (16-17): 1157-1165 (1997); Carter et al., Proc. Natl. Acad. Sci. USA, 89:4285 (1992); Presta et al., J. Immunol., 151:2623 (1993). In some embodiments, the framework region, e.g., all four framework regions, of the heavy chain variable region are derived from a VH4_4-59 germline sequence. In one embodiment, the framework region can comprise, one, two, three, four or five modifications, e.g., substitutions, e.g., conservative substitutions, e.g., from the amino acid at the corresponding murine sequence. In one embodiment, the framework region, e.g., all four framework regions of the light chain variable region are derived from a VK3_1.25 germline sequence. In one embodiment, the framework region can comprise, one, two, three, four or five modifications, e.g., substitutions, e.g., conservative substitutions, e.g., from the amino acid at the corresponding murine sequence.

In certain embodiments, the CD2 binding molecules comprise a heavy chain variable region from a particular germline heavy chain immunoglobulin gene and/or a light chain variable region from a particular germline light chain immunoglobulin gene. For example, such antibodies can comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody (using the methods outlined herein). A human antibody that is "the product of" or "derived from" a particular human germline immunoglobulin sequence can contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody can be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, and ablation variants herein; that is, the number of variants is generally low, prior to the introduction of the variants of the disclosure). In certain cases, the humanized antibody can display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the disclosure).

In one embodiment, the parent antibody has been affinity matured. Structure-based methods can be employed for humanization and affinity maturation, for example as described in U.S. Ser. No. 11/004,590. Selection based methods can be employed to humanize and/or affinity mature antibody variable regions, including but not limited to methods described in Wu et al., 1999, J. Mol. Biol. 294:151-162; Baca et al., 1997, J. Biol. Chem. 272(16): 10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759. Other humanization methods can involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084.

In some embodiments, a CD2 MBM comprises an ABM2 and/or an ABM3 (when present) which is a Fab. Fab domains can be produced by proteolytic cleavage of immunoglobulin molecules, using enzymes such as papain, or through recombinant expression. Fab domains typically comprise a CH1 domain attached to a VH domain which pairs with a CL domain attached to a VL domain. In a wild-type immunoglobulin, the VH domain is paired with the VL domain to constitute the Fv region, and the CH1 domain is paired with the CL domain to further stabilize the binding module. A disulfide bond between the two constant domains can further stabilize the Fab domain.

In some embodiments, a CD2 MBM comprises an ABM2 and/or an ABM3 (when present) which is a scFab. In an embodiment, the antibody domains and the linker in the scFab fragment have one of the following orders in N-terminal to C-terminal direction: a) VH-CH1-linker-VL-CL, or b) VL-CL-linker-VH-CH1. In some cases, VL-CL-linker-VH-CH1 is used.

In another embodiment, the antibody domains and the linker in the scFab fragment have one of the following orders in N-terminal to C-terminal direction: a) VH-CL-linker-VL-CH1 or b) VL-CH1-linker-VH-CL.

Optionally in the scFab fragment, additionally to the natural disulfide bond between the CL-domain and the CH1 domain, also the antibody heavy chain variable domain (VH) and the antibody light chain variable domain (VL) are disulfide stabilized by introduction of a disulfide bond between the following positions: i) heavy chain variable domain position 44 to light chain variable domain position 100, ii) heavy chain variable domain position 105 to light chain variable domain position 43, or iii) heavy chain variable domain position 101 to light chain variable domain position 100 (numbering according to EU index of Kabat).

Such further disulfide stabilization of scFab fragments is achieved by the introduction of a disulfide bond between the variable domains VH and VL of the single chain Fab fragments. Techniques to introduce unnatural disulfide bridges for stabilization for a single chain Fv are described e.g. in WO 94/029350, Rajagopal et al., 1997, Prot. Engin. 10:1453-59; Kobayashi et al., 1998, Nuclear Medicine & Biology, 25:387-393; and Schmidt, et al., 1999, Oncogene 18:1711-1721. In one embodiment, the optional disulfide bond between the variable domains of the scFab fragments is between heavy chain variable domain position 44 and light chain variable domain position 100. In one embodiment, the optional disulfide bond between the variable domains of the scFab fragments is between heavy chain variable domain position 105 and light chain variable domain position 43 (numbering according to EU index of Kabat).

In some embodiments, a CD2 MBM comprises an ABM2 and/or an ABM3 (when present) which is which is a scFv. Single chain Fv antibody fragments comprise the VH and VL domains of an antibody in a single polypeptide chain, are capable of being expressed as a single chain polypeptide, and retain the specificity of the intact antibody from which it is derived. Generally, the scFv polypeptide further comprises a polypeptide linker between the VH and VL domain that enables the scFv to form the desired structure for target binding. Examples of linkers suitable for connecting the VH and VL chains of an scFV are the ABM linkers identified in Section 7.6.3, for example any of the linkers designated L1 through L58.

Unless specified, as used herein an scFv can have the VL and VH variable regions in either order, e.g., with respect to the N-terminal and C-terminal ends of the polypeptide, the scFv can comprise VL-linker-VH or can comprise VH-linker-VL.

To create an scFv-encoding nucleic acid, the VH and VL-encoding DNA fragments are operably linked to another fragment encoding a linker, e.g., encoding any of the linkers described in Section 7.6.3 (such as the amino acid sequence (Gly4"Ser)3 (SEQ ID NO: 717)), such that the VH and VL sequences can be expressed as a contiguous single-chain protein, with the VL and VH regions joined by the flexible linker (see e.g., Bird et al., 1988, Science 242:423-426; Huston et al., 1988, Proc. Natl. Acad. Sci. USA 85:5879-5883; McCafferty et al., 1990, Nature 348:552-554).

In some embodiments, a CD2 MBM comprises an ABM2 and/or an ABM3 (when present) which is a Fv, a dsFv, a (Fab')2, a single domain antibody (SDAB), a VH or VL domain, or a camelid VHH domain (also called a nanobody).

In some embodiments, a CD2 MBM comprises an ABM2 and/or an ABM3 (when present) can comprise a single domain antibody composed of a single VH or VL domain which exhibits sufficient affinity to that ABM's target molecule. In an embodiment, the single domain antibody is a camelid VHH domain (see, e.g., Riechmann, 1999, Journal of Immunological Methods 231:25-38; WO 94/04678).

Immunoglobulin-based ABMs can comprise modifications to framework residues within a VH and/or a VL, e.g. to improve the properties of a MBM containing the ABM. For example, framework modifications can be made to decrease immunogenicity of a MBM. One approach for making such framework modifications is to "back-mutate" one or more framework residues of the ABM to a corresponding germline sequence. Such residues can be identified by comparing framework sequences to germline sequences from which the ABM is derived. To "match" framework region sequences to desired germline configuration, residues can be "back-mutated" to a corresponding germline sequence by, for example, site-directed mutagenesis. MBMs having such "back-mutated" ABMs are intended to be encompassed by the disclosure.

Another type of framework modification involves mutating one or more residues within a framework region, or even within one or more CDR regions, to remove T-cell epitopes to thereby reduce potential immunogenicity of a MBM. This approach is also referred to as "deimmunization" and is described in further detail in U.S. Patent Publication 20030153043 by Carr et al.

ABM2 and/or ABM3, when present, can also be modified to have altered glycosylation, which can be useful, for example, to increase the affinity of a MBM for one or more of its antigens. Such carbohydrate modifications can be accomplished by, for example, altering one or more sites of glycosylation within an ABM sequence. For example, one or more amino acid substitutions can be made that result in elimination of one or more variable region framework glycosylation sites to thereby eliminate glycosylation at that site. Such aglycosylation can increase the affinity of the MBM for an antigen. Such an approach is described in, e.g., U.S. Pat. Nos. 5,714,350 and 6,350,861 by Co et al.

7.5.1. Immunoglobulin Based ABMs 7.5.1.1. Fabs

In certain aspects, ABM2 and/or ABM3 (when present) is a Fab domain.

For the MBMs of the disclosure, it is advantageous to use Fab heterodimerization strategies to permit the correct association of Fab domains belonging to the same ABM and minimize aberrant pairing of Fab domains belonging to different ABMs. For example, the Fab heterodimerization strategies shown in Table 2 below can be used:

TABLE 2

Fab Heterodimerization Strategies

| Name | STRATEGY | VH | CH1 | VL | CL | REFERENCE |
|---|---|---|---|---|---|---|
| F1 | CrossMabCH1-CL | WT | CL domain | WT | CH1 domain | Schaefer et al., 2011, Cancer Cell 2011; 20: 472-86; PMID: 22014573. |
| F2 | orthogonal Fab VHVRD1CH1CRD2 - VLVRD1CλCRD2 | 39K, 62E | H172A, F174G | 1R, 38D, (36F) | L135Y, S176W | Lewis et al., 2014, Nat Biotechnol 32: 191-8 |
| F3 | orthogonal Fab VHVRD2CH1wt - VLVRD2Cλwt | 39Y | WT | 38R | WT | Lewis et al., 2014, Nat Biotechnol 32: 191-8 |
| F4 | TCR CαCβ | 39K | TCR Cα | 38D | TCR Cβ | Wu et al., 2015, MAbs 7: 364-76 |
| F5 | CR3 | WT | T192E | WT | N137K, S114A | Golay at al., 2016, J Immunol 196: 3199-211. |
| F6 | MUT4 | WT | L143Q, S188V | WT | V133T, S176V | Golay at al., 2016, J Immunol 196: 3199-211. |

TABLE 2-continued

Fab Heterodimerization Strategies

| Name | STRATEGY | VH | CH1 | VL | CL | REFERENCE |
|------|----------|----|----|----|----|-----------|
| F7 | DuetMab | WT | F126C | WT | S121C | Mazor et al., 2015, MAbs 7: 377-89; Mazor et al., 2015, MAbs 7: 461-669. |

Accordingly, in certain embodiments, correct association between the two polypeptides of a Fab is promoted by exchanging the VL and VH domains of the Fab for each other or exchanging the CH1 and CL domains for each other, e.g., as described in WO 2009/080251.

Correct Fab pairing can also be promoted by introducing one or more amino acid modifications in the CH1 domain and one or more amino acid modifications in the CL domain of the Fab and/or one or more amino acid modifications in the VH domain and one or more amino acid modifications in the VL domain. The amino acids that are modified are typically part of the VH:VL and CH1:CL interface such that the Fab components preferentially pair with each other rather than with components of other Fabs.

In one embodiment, the one or amino acid modifications are limited to the conserved framework residues of the variable (VH, VL) and constant (CH1, CL) domains as indicated by the Kabat numbering of residues. Almagro, 2008, Frontiers In Bioscience 13:1619-1633 provides a definition of the framework residues on the basis of Kabat, Chothia, and IMGT numbering schemes.

In one embodiment, the modifications introduced in the VH and CH1 and/or VL and CL domains are complementary to each other. Complementarity at the heavy and light chain interface can be achieved on the basis of steric and hydrophobic contacts, electrostatic/charge interactions or a combination of the variety of interactions. The complementarity between protein surfaces is broadly described in the literature in terms of lock and key fit, knob into hole, protrusion and cavity, donor and acceptor etc., all implying the nature of structural and chemical match between the two interacting surfaces.

In one embodiment, the one or more introduced modifications introduce a new hydrogen bond across the interface of the Fab components. In one embodiment, the one or more introduced modifications introduce a new salt bridge across the interface of the Fab components. Exemplary substitutions are described in WO 2014/150973 and WO 2014/082179.

In some embodiments, the Fab domain comprises a 192E substitution in the CH1 domain and 114A and 137K substitutions in the CL domain, which introduces a salt-bridge between the CH1 and CL domains (see, Golay et al., 2016, J Immunol 196:3199-211).

In some embodiments, the Fab domain comprises a 143Q and 188V substitutions in the CH1 domain and 113T and 176V substitutions in the CL domain, which serves to swap hydrophobic and polar regions of contact between the CH1 and CL domain (see, Golay et al., 2016, J Immunol 196: 3199-211).

In some embodiments, the Fab domain can comprise modifications in some or all of the VH, CH1, VL, CL domains to introduce orthogonal Fab interfaces which promote correct assembly of Fab domains (Lewis et al., 2014 Nature Biotechnology 32:191-198). In an embodiment, 39K, 62E modifications are introduced in the VH domain, H172A, F174G modifications are introduced in the CH1 domain, 1R, 38D, (36F) modifications are introduced in the VL domain, and L135Y, S176W modifications are introduced in the CL domain. In another embodiment, a 39Y modification is introduced in the VH domain and a 38R modification is introduced in the VL domain.

Fab domains can also be modified to replace the native CH1:CL disulfide bond with an engineered disulfide bond, thereby increasing the efficiency of Fab component pairing. For example, an engineered disulfide bond can be introduced by introducing a 126C in the CH1 domain and a 121C in the CL domain (see, Mazor et al., 2015, MAbs 7:377-89).

Fab domains can also be modified by replacing the CH1 domain and CL domain with alternative domains that promote correct assembly. For example, Wu et al., 2015, MAbs 7:364-76, describes substituting the CH1 domain with the constant domain of the α T cell receptor and substituting the CL domain with the β domain of the T cell receptor, and pairing these domain replacements with an additional charge-charge interaction between the VL and VH domains by introducing a 38D modification in the VL domain and a 39K modification in the VH domain.

ABMs can comprise a single chain Fab fragment, which is a polypeptide consisting of an antibody heavy chain variable domain (VH), an antibody constant domain 1 (CH1), an antibody light chain variable domain (VL), an antibody light chain constant domain (CL) and a linker. In some embodiments, the antibody domains and the linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL. The linker can be a polypeptide of at least 30 amino acids, e.g., between 32 and 50 amino acids. The single chain Fab domains are stabilized via the natural disulfide bond between the CL domain and the CH1 domain.

In an embodiment, the antibody domains and the linker in the single chain Fab fragment have one of the following orders in N-terminal to C-terminal direction: a) VH-CH1-linker-VL-CL, or b) VL-CL-linker-VH-CH1. In some cases, VL-CL-linker-VH-CH1 is used.

In another embodiment, the antibody domains and the linker in the single chain Fab fragment have one of the following orders in N-terminal to C-terminal direction: a) VH-CL-linker-VL-CH1 or b) VL-CH1-linker-VH-CL.

Optionally in the single chain Fab fragment, additionally to the natural disulfide bond between the CL-domain and the CH1 domain, also the antibody heavy chain variable domain (VH) and the antibody light chain variable domain (VL) ABM are disulfide stabilized by introduction of a disulfide bond between the following positions: i) heavy chain variable domain position 44 to light chain variable domain position 100, ii) heavy chain variable domain position 105 to light chain variable domain position 43, or iii) heavy chain variable domain position 101 to light chain variable domain position 100 (numbering according to EU index of Kabat).

In one embodiment, the optional disulfide bond between the variable domains of the single chain Fab fragments is between heavy chain variable domain position 44 and light chain variable domain position 100. In one embodiment, the optional disulfide bond between the variable domains of the single chain Fab fragments is between heavy chain variable domain position 105 and light chain variable domain position 43 (numbering according to EU index of Kabat).

7.5.1.2. scFvs

In certain aspects, an ABM is a single chain Fv or "scFv". Examples of linkers suitable for connecting the VH and VL chains of an scFV are the ABM linkers identified in Section 7.6.3, for example any of the linkers designated L1 through L54.

To create an scFv-encoding nucleic acid, the VH and VL-encoding DNA fragments are operably linked to another fragment encoding a linker, e.g., encoding any of the ABM linkers described in Section 7.6.3 (such as the amino acid sequence (Gly4"Ser)3 (SEQ ID NO: 717).

7.5.1.3. Other Immunoglobulin-Based ABMs.

MBMs can also comprise ABMs having an immunoglobulin format which is other than Fab or scFv, for example Fv, dsFv, (Fab')2, a single domain antibody (SDAB), a VH or VL domain, or a camelid VHH domain (also called a nanobody).

An ABM2 and/or ABM3 (when present) can be a single domain antibody composed of a single VH or VL domain which exhibits sufficient affinity to the target. In an embodiment, the single domain antibody is a camelid VHH domain (see, e.g., Riechmann, 1999, Journal of Immunological Methods 231:25-38; WO 94/04678).

7.5.2. Non-Immunoglobulin Based ABM

In certain embodiments, ABM2 and/or ABM3 (when present) is derived from non-antibody scaffold proteins (including, but not limited to, designed ankyrin repeat proteins (DARPins), Avimers (short for avidity multimers), Anticalin/Lipocalins, Centyrins, Kunitz domains, Adnexins, Affilins, Affitins (also known as Nonfitins), Knottins, Pronectins, Versabodies, Duocalins, and Fynomers), ligands, receptors, cytokines or chemokines.

Non-immunoglobulin scaffolds that can be used in the MBMs include those listed in Tables 3 and 4 of Mintz and Crea, 2013, Bioprocess International 11(2):40-48; in FIG. 1, Table 1 and Figure I of Vazquez-Lombardi et al., 2015, Drug Discovery Today 20(10):1271-83; in Table 1 and Box 2 of Skrlec et al., 2015, Trends in Biotechnology 33(7):408-18. The contents of Tables 3 and 4 of Mintz and Crea, 2013, Bioprocess International 11(2):40-48; in FIG. 1, Table 1 and Figure I of Vazquez-Lombardi et al., 2015, Drug Discovery Today 20(10):1271-83; in Table 1 and Box 2 of Skrlec et al., 2015, Trends in Biotechnology 33(7):408-18 (collectively, "Scaffold Disclosures"). In a particular embodiment, the Scaffold Disclosures are incorporated by reference for what they disclose relating to Adnexins. In another embodiment, the Scaffold Disclosures are incorporated by reference for what they disclose relating to Avimers. In another embodiment, the Scaffold Disclosures are incorporated by reference for what they disclose relating to Affibodies. In yet another embodiment, the Scaffold Disclosures are incorporated by reference for what they disclose relating to Anticalins. In yet another embodiment, the Scaffold Disclosures are incorporated by reference for what they disclose relating to DARPins. In yet another embodiment, the Scaffold Disclosures are incorporated by reference for what they disclose relating to Kunitz domains. In yet another embodiment, the Scaffold Disclosures are incorporated by reference for what they disclose relating to Knottins. In yet another embodiment, the Scaffold Disclosures are incorporated by reference for what they disclose relating to Pronectins. In yet another embodiment, the Scaffold Disclosures are incorporated by reference for what they disclose relating to Nanofitins. In yet another embodiment, the Scaffold Disclosures are incorporated by reference for what they disclose relating to Affilins. In yet another embodiment, the Scaffold Disclosures are incorporated by reference for what they disclose relating to Adnectins. In yet another embodiment, the Scaffold Disclosures are incorporated by reference for what they disclose relating to ABMs. In yet another embodiment, the Scaffold Disclosures are incorporated by reference for what they disclose relating to Adhirons. In yet another embodiment, the Scaffold Disclosures are incorporated by reference for what they disclose relating to Affimers. In yet another embodiment, the Scaffold Disclosures are incorporated by reference for what they disclose relating to Alphabodies. In yet another embodiment, the Scaffold Disclosures are incorporated by reference for what they disclose relating to Armadillo Repeat Proteins. In yet another embodiment, the Scaffold Disclosures are incorporated by reference for what they disclose relating to Atrimers/Tetranectins. In yet another embodiment, the Scaffold Disclosures are incorporated by reference for what they disclose relating to Obodies/OB-folds. In yet another embodiment, the Scaffold Disclosures are incorporated by reference for what they disclose relating to Centyrins. In yet another embodiment, the Scaffold Disclosures are incorporated by reference for what they disclose relating to Repebodies. In yet another embodiment, the Scaffold Disclosures are incorporated by reference for what they disclose relating to Anticalins. In yet another embodiment, the Scaffold Disclosures are incorporated by reference for what they disclose relating to Atrimers. In yet another embodiment, the Scaffold Disclosures are incorporated by reference for what they disclose relating to bicyclic peptides. In yet another embodiment, the Scaffold Disclosures are incorporated by reference for what they disclose relating to cys-knots. In yet another embodiment, the Scaffold Disclosures are incorporated by reference for what they disclose relating to Fn3 scaffolds (including Adnectins, Centryrins, Pronectins, and Tn3).

In an embodiment, an ABM2 and/or ABM3 (when present) can be a designed ankyrin repeat protein ("DARPin"). DARPins are antibody mimetic proteins that typically exhibit highly specific and high-affinity target protein binding. They are typically genetically engineered and derived from natural ankyrin proteins and consist of at least three, usually four or five repeat motifs of these proteins. Their molecular mass is about 14 or 18 kDa (kilodaltons) for four- or five-repeat DARPins, respectively. Examples of DARPins can be found, for example in U.S. Pat. No. 7,417,130. Multispecific binding molecules comprising DARPin binding modules and immunoglobulin-based binding modules are disclosed in, for example, U.S. Publication No. 2015/0030596 A1.

In another embodiment, ABM2 and/or ABM3 (when present) can be an Affibody. An Affibody is well known and refers to affinity proteins based on a 58 amino acid residue protein domain, derived from one of the IgG binding domain of staphylococcal protein A.

In another embodiment, ABM2 and/or ABM3 (when present) can be an Anticalin. Anticalins are well known and refer to another antibody mimetic technology, where the binding specificity is derived from Lipocalins. Anticalins can also be formatted as dual targeting protein, called Duocalins.

In another embodiment, ABM2 and/or ABM3 (when present) can be a Versabody. Versabodies are well known and refer to another antibody mimetic technology. They are small proteins of 3-5 kDa with >15% cysteines, which form a high disulfide density scaffold, replacing the hydrophobic core of typical proteins.

Other non-immunoglobulin ABMs include "A" domain oligomers (also known as Avimers) (see for example, U.S. Patent Application Publication Nos. 2005/0164301, 2005/0048512, and 2004/017576), Fn3 based protein scaffolds (see for example, U.S. Patent Application Publication 2003/0170753), VASP polypeptides, Avian pancreatic polypeptide (aPP), Tetranectin (based on CTLD3), Affililin (based on γB-crystallin/ubiquitin), Knottins, SH3 domains, PDZ domains, Tendamistat, Neocarzinostatin, Protein A domains, Lipocalins, Transferrin, or Kunitz domains. In one aspect, ABMs useful in the construction of the MBMs comprise fibronectin-based scaffolds as exemplified in WO 2011/130324.

Moreover, in certain aspects, ABM2 and/or ABM3 (when present) can comprise a ligand binding domain of a receptor or a receptor binding domain of a ligand.

7.6. Connectors

It is contemplated that the CD2 binding molecules can in some instances include pairs of ABMs or ABM chains (e.g., the VH-CH1 or VL-CL component of a Fab) connected directly to one another, e.g., as a fusion protein without a linker. For example, the CD2 binding molecules comprise connector moieties linking individual ABMs or ABM chains. The use of connector moieties can improve target binding, for example by increasing flexibility of the ABMs within a CD2 binding molecule and thus reducing steric hindrance. The ABMs or ABM chains can be connected to one another through, for example, Fc domains (each Fc domain representing a pair of associated Fc regions) and/or ABM linkers. The use of Fc domains will typically require the use of hinge regions as connectors of the ABMs or ABM chains for optimal antigen binding. Thus, the term "connector" encompasses, but is not limited to, Fc regions, Fc domains, and hinge regions.

Connectors can be selected or modified to, for example, increase or decrease the biological half-life of a CD2 binding molecule. For example, to decrease biological half-life, one or more amino acid mutations can be introduced into a CH2-CH3 domain interface region of an Fc-hinge fragment such that a CD2 binding molecule comprising the fragment has impaired Staphylococcyl Protein A (SpA) binding relative to native Fc-hinge domain SpA binding. This approach is described in further detail in U.S. Pat. No. 6,165,745 by Ward et al. Alternatively, a CD2 binding molecule can be modified to increase its biological half-life. For example, one or more of the following mutations can be introduced: T252L, T254S, T256F, as described in U.S. Pat. No. 6,277,375 to Ward. Alternatively, to increase the biological half-life, a CD2 binding molecule can be altered within a CH1 or CL region to contain a salvage receptor binding epitope taken from two loops of a CH2 domain of an Fc region of an IgG, as described in U.S. Pat. Nos. 5,869,046 and 6,121,022 by Presta et al.

Examples of Fc domains (formed by the pairing of two Fc regions), hinge regions and ABM linkers are described in Sections 7.6.1, 7.6.2, and 7.6.3, respectively.

7.6.1. Fc Domains

The CD2 binding molecules can include an Fc domain derived from any suitable species. In one embodiment, the Fc domain is derived from a human Fc domain.

The Fc domain can be derived from any suitable class of antibody, including IgA (including subclasses IgA1 and IgA2), IgD, IgE, IgG (including subclasses IgG1, IgG2, IgG3 and IgG4), and IgM. In one embodiment, the Fc domain is derived from IgG1, IgG2, IgG3 or IgG4. In one embodiment, the Fc domain is derived from IgG1. In one embodiment, the Fc domain is derived from IgG4.

The Fc domain comprises two polypeptide chains, each referred to as a heavy chain Fc region. The two heavy chain Fc regions dimerize to create the Fc domain. The two Fc regions within the Fc domain can be the same or different from one another. In a native antibody the Fc regions are typically identical, but for the purpose of producing multispecific binding molecules of the disclosure, the Fc regions might advantageously be different to allow for heterodimerization, as described in Section 7.6.1.5 below.

Typically each heavy chain Fc region comprises or consists of two or three heavy chain constant domains.

In native antibodies, the heavy chain Fc region of IgA, IgD and IgG is composed of two heavy chain constant domains (CH2 and CH3) and that of IgE and IgM is composed of three heavy chain constant domains (CH2, CH3 and CH4). These dimerize to create an Fc domain.

In the present disclosure, the heavy chain Fc region can comprise heavy chain constant domains from one or more different classes of antibody, for example one, two or three different classes.

In one embodiment, the heavy chain Fc region comprises CH2 and CH3 domains derived from IgG1. An exemplary sequence of a heavy chain Fc region derived from human IgG1 is given in SEQ ID NO:1338:

```
                                     (SEQ ID NO: 1338)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSP.
```

In some embodiments, a CD2 binding molecule of the disclosure comprises a Fc region whose amino acid sequence comprises the amino acid sequence of SEQ ID NO:1338 modified with one or more of the substitutions described in Section 7.6.1 and its subparts.

In one embodiment, the heavy chain Fc region comprises CH2 and CH3 domains derived from IgG2.

In one embodiment, the heavy chain Fc region comprises CH2 and CH3 domains derived from IgG3.

In one embodiment, the heavy chain Fc region comprises CH2 and CH3 domains derived from IgG4.

In one embodiment, the heavy chain Fc region comprises a CH4 domain from IgM. The IgM CH4 domain is typically located at the C-terminus of the CH3 domain.

In one embodiment, the heavy chain Fc region comprises CH2 and CH3 domains derived from IgG and a CH4 domain derived from IgM.

It will be appreciated that the heavy chain constant domains for use in producing a heavy chain Fc region for the CD2 binding molecules of the present disclosure can include variants of the naturally occurring constant domains described above. Such variants can comprise one or more amino acid variations compared to wild type constant domains. In one example the heavy chain Fc region of the present disclosure comprises at least one constant domain that varies in sequence from the wild type constant domain. It will be appreciated that the variant constant domains can be longer or shorter than the wild type constant domain. For example, the variant constant domains are at least 60% identical or similar to a wild type constant domain. In another example the variant constant domains are at least 70% identical or similar. In another example the variant constant domains are at least 75% identical or similar. In another example the variant constant domains are at least 80% identical or similar. In another example the variant constant domains are at least 85% identical or similar. In another example the variant constant domains are at least 90% identical or similar. In another example the variant constant domains are at least 95% identical or similar. In another example the variant constant domains are at least 99% identical or similar. Exemplary Fc variants are described in Sections 7.6.1.1 through 7.6.1.5, infra.

IgM and IgA occur naturally in humans as covalent multimers of the common H2L2 antibody unit. IgM occurs as a pentamer when it has incorporated a J-chain, or as a hexamer when it lacks a J-chain. IgA occurs as monomer and dimer forms. The heavy chains of IgM and IgA possess an 18 amino acid extension to the C-terminal constant domain, known as a tailpiece. The tailpiece includes a cysteine residue that forms a disulfide bond between heavy chains in the polymer, and is believed to have an important role in polymerization. The tailpiece also contains a glycosylation site. In certain embodiments, the CD2 binding molecules of the present disclosure do not comprise a tailpiece.

The Fc domains that are incorporated into the CD2 binding molecules of the present disclosure can comprise one or more modifications that alter one or more functional properties of the proteins, such as serum half-life, complement fixation, Fc receptor binding, and/or antigen-dependent cellular cytotoxicity. Furthermore, a CD2 binding molecule can be chemically modified (e.g., one or more chemical moieties can be attached to the CD2 binding molecule) or be modified to alter its glycosylation, again to alter one or more functional properties of the CD2 binding molecule.

Effector function of an antibody molecule includes complement-mediated effector function, which is mediated by, for example, binding of the C1 component of the complement to the antibody. Activation of complement is important in the opsonization and direct lysis of pathogens. In addition, it stimulates the inflammatory response by recruiting and activating phagocytes to the site of complement activation. Effector function includes Fc receptor (FcR)-mediated effector function, which can be triggered upon binding of the constant domains of an antibody to an Fc receptor (FcR). Antigen-antibody complex-mediated crosslinking of Fc receptors on effector cell surfaces triggers a number of important and diverse biological responses including engulfment and destruction of antibody-coated particles, clearance of immune complexes, lysis of antibody-coated target cells by killer cells (called antibody-dependent cell-mediated cytotoxicity, or ADCC), release of inflammatory mediators, placental transfer and control of immunoglobulin production.

Fc regions can be altered by replacing at least one amino acid residue with a different amino acid residue to alter the effector functions. For example, one or more amino acids can be replaced with a different amino acid residue such that the Fc region has an altered affinity for an effector ligand. The effector ligand to which affinity is altered can be, for example, an Fc receptor or the C1 component of complement. This approach is described in, e.g., U.S. Pat. Nos. 5,624,821 and 5,648,260, both by Winter et al. Modified Fc regions can also alter C1q binding and/or reduce or abolish complement dependent cytotoxicity (CDC). This approach is described in, e.g., U.S. Pat. No. 6,194,551 by Idusogie et al. Modified Fc regions can also alter the ability of an Fc region to fix complement. This approach is described in, e.g., the PCT Publication WO 94/29351 by Bodmer et al. Allotypic amino acid residues include, but are not limited to, constant region of a heavy chain of the IgG1, IgG2, and IgG3 subclasses as well as constant region of a light chain of the kappa isotype as described by Jefferis et al., 2009, MAbs, 1:332-338.

Fc regions can also be modified to "silence" the effector function, for example, to reduce or eliminate the ability of a CD2 binding molecule to mediate antibody dependent cellular cytotoxicity (ADCC) and/or antibody dependent cellular phagocytosis (ADCP). This can be achieved, for example, by introducing a mutation in an Fc region. Such mutations have been described in the art: LALA and N297A (Strohl, 2009, Curr. Opin. Biotechnol. 20(6):685-691); and D265A (Baudino et al., 2008, J. Immunol. 181: 6664-69; Strohl, supra). Examples of silent Fc IgG1 antibodies comprise the so-called LALA mutant comprising L234A and L235A mutation in the IgG1 Fc amino acid sequence. Another example of a silent IgG1 antibody comprises the D265A mutation. Another silent IgG1 antibody comprises the so-called DAPA mutant comprising D265A and P329A mutations in the IgG1 Fc amino acid sequence. Another silent IgG1 antibody comprises the N297A mutation, which results in aglycosylated/non-glycosylated antibodies.

Fc regions can be modified to increase the ability of a CD2 binding molecule containing the Fc region to mediate antibody dependent cellular cytotoxicity (ADCC) and/or antibody dependent cellular phagocytosis (ADCP), for example, by modifying one or more amino acid residues to increase the affinity of the CD2 binding molecule for an activating Fcγ receptor, or to decrease the affinity of the CD2 binding molecule for an inhibitory Fcγ receptor. Human activating Fcγ receptors include FcγRIa, FcγRIIa, FcγRIIIa, and FcγRIIIb, and human inhibitory Fcγ receptor includes FcγRIIb. This approach is described in, e.g., the PCT Publication WO 00/42072 by Presta. Moreover, binding sites on human IgG1 for FcγRI, FcγRII, FcγRIII and FcRn have been mapped and variants with improved binding have been described (see Shields et al., J. Biol. Chem. 276:6591-6604, 2001). Optimization of Fc-mediated effector functions of monoclonal antibodies such as increased ADCC/ADCP function has been described (see Strohl, 2009, Current Opinion in Biotechnology 20:685-691). Mutations that can enhance ADCC/ADCP function include one or more mutations selected from G236A, S239D, F243L, P2471, D280H, K290S, R292P, S298A, S298D, S298V, Y300L, V305I, A330L, I332E, E333A, K334A, A339D, A339Q, A339T, and P396L (all positions by EU numbering).

Fc regions can also be modified to increase the ability of a CD2 binding molecule to mediate ADCC and/or ADCP, for example, by modifying one or more amino acids to increase the affinity of the CD2 binding molecule for an activating receptor that would typically not recognize the parent CD2 binding molecule, such as FcαRI. This approach is described in, e.g., Borrok et al., 2015, mAbs. 7(4):743-751.

Accordingly, in certain aspects, the CD2 binding molecules of the present disclosure can include Fc domains with altered effector function such as, but not limited to, binding to Fc-receptors such as FcRn or leukocyte receptors (for example, as described above or in Section 7.6.1.1), binding to complement (for example as described above or in Section 7.6.1.2), modified disulfide bond architecture (for example as described above or in Section 7.6.1.3), or altered glycosylation patterns (for example as described above or in Section 7.6.1.4). The Fc domains can also be altered to include modifications that improve manufacturability of asymmetric CD2 binding molecules, for example by allowing heterodimerization, which is the preferential pairing of non-identical Fc regions over identical Fc regions. Heterodimerization permits the production of CD2 binding molecules in which different ABMs are connected to one another by an Fc domain containing Fc regions that differ in sequence. Examples of heterodimerization strategies are exemplified in Section 7.6.1.5 (and subsections thereof).

It will be appreciated that any of the modifications described in Sections 7.6.1.1 through 7.6.1.5 can be combined in any suitable manner to achieve the desired functional properties and/or combined with other modifications to alter the properties of the CD2 binding molecules. In some embodiments, a CD2 binding molecule comprises a IgG1 Fc domain having a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 (EU numbering). For example, a CD2 binding molecule can comprise an IgG1 sequence of SEQ ID NO:1338 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332.

7.6.1.1. Fc Domains with Altered FcR Binding

The Fc domains of the CD2 binding molecules can show altered binding to one or more Fc-receptors (FcRs) in comparison with the corresponding native immunoglobulin. The binding to any particular Fc-receptor can be increased or decreased. In one embodiment, the Fc domain comprises one or more modifications which alter its Fc-receptor binding profile.

Human cells can express a number of membrane bound FcRs selected from FcαR, FcεR, FcγR, FcRn and glycan receptors. Some cells are also capable of expressing soluble (ectodomain) FcR (Fridman et al., 1993, J Leukocyte Biology 54: 504-512). FcγR can be further divided by affinity of IgG binding (high/low) and biological effect (activating/inhibiting). Human FcγRI is widely considered to be the sole 'high affinity' receptor whilst all of the others are considered as medium to low. FcγRIIb is the sole receptor with 'inhibitory' functionality by virtue of its intracellular ITIM motif whilst all of the others are considered as 'activating' by virtue of ITAM motifs or pairing with the common FcγR-γchain. FcγRIIIb is also unique in that although activatory it associates with the cell via a GPI anchor. In total, humans express six "standard" FcγRs: FcγRI, FcγRIIa, FcγRIIb, FcγRIIc, FcγRIIIa, and FcγRIIIb. In addition to these sequences there are a large number of sequence or allotypic variants spread across these families. Some of these have been found to have important functional consequence and so are sometimes considered to be receptor sub-types of their own. Examples include FcγRIIa$^{H134R}$, FcγRIIb$^{I190T}$, FcγRIIIa$^{F158V}$, FcγRIIIb$^{NA1}$, FcγRIIIb$^{NA2}$, and FcγRIII$^{SH}$. Each receptor sequence has been shown to have different affinities for the 4 sub-classes of IgG: IgG1, IgG2, IgG3 and IgG4 (Bruhns, 1993, Blood 113:3716-3725). Other species have somewhat different numbers and functionality of FcγR, with the mouse system being the best studied to date and comprising of 4 FcγR, FcγRI FcγRIIb FcγRIII FcγRIV (Bruhns, 2012, Blood 119:5640-5649). Human FcγRI on cells is normally considered to be "occupied" by monomeric IgG in normal serum conditions due to its affinity for IgG1/IgG3/IgG4 (about $10^{-8}$ M) and the concentration of these IgG in serum (about 10 mg/ml). Hence cells bearing FcγRI on their surface are considered to be capable for "screening" or "sampling" of their antigenic environment vicariously through the bound polyspecific IgG. The other receptors having lower affinities for IgG sub-classes (in the range of about $10^{-5}$-$10^{-7}$ M) are normally considered to be "unoccupied." The low affinity receptors are hence inherently sensitive to the detection of and activation by antibody involved immune complexes. The increased Fc density in an antibody immune complex results in increased functional affinity of binding avidity to low affinity FcγR. This has been demonstrated in vitro using a number of methods (Shields et al., 2001, J Biol Chem 276(9):6591-6604; Lux et al., 2013, J Immunol 190:4315-4323). It has also been implicated as being one of the primary modes of action in the use of anti-RhD to treat ITP in humans (Crow, 2008, Transfusion Medicine Reviews 22:103-116).

Many cell types express multiple types of FcγR and so binding of IgG or antibody immune complex to cells bearing FcγR can have multiple and complex outcomes depending upon the biological context. Most simply, cells can either receive an activatory, inhibitory or mixed signal. This can result in events such as phagocytosis (e.g., macrophages and neutrophils), antigen processing (e.g., dendritic cells), reduced IgG production (e.g., B-cells) or degranulation (e.g., neutrophils, mast cells). There are data to support that the inhibitory signal from FcγRIIb can dominate that of activatory signals (Proulx, 2010, Clinical Immunology 135:422-429).

There are a number of useful Fc substitutions that can be made to alter binding to one or more of the FcγR receptors. Substitutions that result in increased binding as well as decreased binding can be useful. For example, it is known that increased binding to FcγRIIIa generally results in increased ADCC (antibody dependent cell-mediated cytotoxicity; the cell-mediated reaction where nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present disclosure include those listed in US 2006/0024298 (particularly FIG. 41), US 2006/0121032, US 2006/0235208, US 2007/0148170, and US 2019/0100587. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V, 299T, 265A/297A/329A, 265N/297D/329G, and 265E/297Q/329S.

FcRn has a crucial role in maintaining the long half-life of IgG in the serum of adults and children. The receptor binds IgG in acidified vesicles (pH<6.5) protecting the IgG molecule from degradation, and then releasing it at the higher pH of 7.4 in blood.

FcRn is unlike leukocyte Fc receptors, and instead, has structural similarity to MHC class I molecules. It is a heterodimer composed of a $\beta_2$-microglobulin chain, non-covalently attached to a membrane-bound chain that includes three extracellular domains. One of these domains, including a carbohydrate chain, together with $\beta_2$-microglobulin interacts with a site between the CH2 and CH3 domains of Fc. The interaction includes salt bridges made to histidine residues on IgG that are positively charged at pH<6.5. At higher pH, the His residues lose their positive charges, the FcRn-IgG interaction is weakened and IgG dissociates.

In one embodiment, a CD2 binding molecule comprises an Fc domain that binds to human FcRn.

In one embodiment, the Fc domain has an Fc region(s) (e.g., one or two) comprising a histidine residue at position 310, and in some cases also at position 435. These histidine residues are important for human FcRn binding. In one embodiment, the histidine residues at positions 310 and 435 are native residues, i.e., positions 310 and 435 are not modified. Alternatively, one or both of these histidine residues can be present as a result of a modification.

The CD2 binding molecules can comprise one or more Fc regions that alter Fc binding to FcRn. The altered binding can be increased binding or decreased binding.

In one embodiment, the CD2 binding molecule comprises an Fc domain in which at least one (and optionally both) Fc regions comprises one or more modifications such that it binds to FcRn with greater affinity and avidity than the corresponding native immunoglobulin.

Fc substitutions that increase binding to the FcRn receptor and increase serum half life are described in US 2009/0163699, including, but not limited to, 434S, 434A, 428L, 308F, 259I, 428L/434S, 259I/308F, 436I/428L, 436I or V/434S, 436V/428L and 259I/308F/428L.

In one embodiment, the Fc region is modified by substituting the threonine residue at position 250 with a glutamine residue (T250Q).

In one embodiment, the Fc region is modified by substituting the methionine residue at position 252 with a tyrosine residue (M252Y).

In one embodiment, the Fc region is modified by substituting the serine residue at position 254 with a threonine residue (S254T).

In one embodiment, the Fc region is modified by substituting the threonine residue at position 256 with a glutamic acid residue (T256E).

In one embodiment, the Fc region is modified by substituting the threonine residue at position 307 with an alanine residue (T307A).

In one embodiment, the Fc region is modified by substituting the threonine residue at position 307 with a proline residue (T307P).

In one embodiment, the Fc region is modified by substituting the valine residue at position 308 with a cysteine residue (V308C).

In one embodiment, the Fc region is modified by substituting the valine residue at position 308 with a phenylalanine residue (V308F).

In one embodiment, the Fc region is modified by substituting the valine residue at position 308 with a proline residue (V308P).

In one embodiment, the Fc region is modified by substituting the glutamine residue at position 311 with an alanine residue (Q311A).

In one embodiment, the Fc region is modified by substituting the glutamine residue at position 311 with an arginine residue (Q311R).

In one embodiment, the Fc region is modified by substituting the methionine residue at position 428 with a leucine residue (M428L).

In one embodiment, the Fc region is modified by substituting the histidine residue at position 433 with a lysine residue (H433K).

In one embodiment, the Fc region is modified by substituting the asparagine residue at position 434 with a phenylalanine residue (N434F).

In one embodiment, the Fc region is modified by substituting the asparagine residue at position 434 with a tyrosine residue (N434Y).

In one embodiment, the Fc region is modified by substituting the methionine residue at position 252 with a tyrosine residue, the serine residue at position 254 with a threonine residue, and the threonine residue at position 256 with a glutamic acid residue (M252Y/S254T/T256E).

In one embodiment, the Fc region is modified by substituting the valine residue at position 308 with a proline residue and the asparagine residue at position 434 with a tyrosine residue (V308P/N434Y).

In one embodiment, the Fc region is modified by substituting the methionine residue at position 252 with a tyrosine residue, the serine residue at position 254 with a threonine residue, the threonine residue at position 256 with a glutamic acid residue, the histidine residue at position 433 with a lysine residue and the asparagine residue at position 434 with a phenylalanine residue (M252Y/S254T/T256E/H433K/N434F).

It will be appreciated that any of the modifications listed above can be combined to alter FcRn binding.

In one embodiment, the CD2 binding molecule comprises an Fc domain in which one or both Fc regions comprise one or more modifications such that the Fc domain binds to FcRn with lower affinity and avidity than the corresponding native immunoglobulin.

In one embodiment, the Fc region comprises any amino acid residue other than histidine at position 310 and/or position 435.

The CD2 binding molecule can comprise an Fc domain in which one or both Fc regions comprise one or more modifications which increase its binding to FcγRIIb. FcγRIIb is the only inhibitory receptor in humans and the only Fc receptor found on B cells.

In one embodiment, the Fc region is modified by substituting the proline residue at position 238 with an aspartic acid residue (P238D).

In one embodiment, the Fc region is modified by substituting the glutamic acid residue at position 258 with an alanine residue (E258A).

In one embodiment, the Fc region is modified by substituting the serine residue at position 267 with an alanine residue (S267A).

In one embodiment, the Fc region is modified by substituting the serine residue at position 267 with a glutamic acid residue (S267E).

In one embodiment, the Fc region is modified by substituting the leucine residue at position 328 with a phenylalanine residue (L328F).

In one embodiment, the Fc region is modified by substituting the glutamic acid residue at position 258 with an alanine residue and the serine residue at position 267 with an alanine residue (E258A/S267A).

In one embodiment, the Fc region is modified by substituting the serine residue at position 267 with a glutamic acid residue and the leucine residue at position 328 with a phenylalanine residue (S267E/L328F).

It will be appreciated that any of the modifications listed above can be combined to increase FcγRIIb binding.

In one embodiment, CD2 binding molecules are provided comprising Fc domains which display decreased binding to FcγR.

In one embodiment, the CD2 binding molecule comprises an Fc domain in which one or both Fc regions comprise one or more modifications that decrease Fc binding to FcγR.

The Fc domain can be derived from IgG1.

In one embodiment, the Fc region is modified by substituting the leucine residue at position 234 with an alanine residue (L234A).

In one embodiment, the Fc region is modified by substituting the leucine residue at position 235 with an alanine residue (L235A).

In one embodiment, the Fc region is modified by substituting the glycine residue at position 236 with an arginine residue (G236R).

In one embodiment, the Fc region is modified by substituting the asparagine residue at position 297 with an alanine residue (N297A) or a glutamine residue (N297Q).

In one embodiment, the Fc region is modified by substituting the serine residue at position 298 with an alanine residue (S298A).

In one embodiment, the Fc region is modified by substituting the leucine residue at position 328 with an arginine residue (L328R).

In one embodiment, the Fc region is modified by substituting the leucine residue at position 234 with an alanine residue and the leucine residue at position 235 with an alanine residue (L234A/L235A).

In one embodiment, the Fc region is modified by substituting the phenylalanine residue at position 234 with an alanine residue and the leucine residue at position 235 with an alanine residue (F234A/L235A).

In one embodiment, the Fc region is modified by substituting the glycine residue at position 236 with an arginine residue and the leucine residue at position 328 with an arginine residue (G236R/L328R).

In one embodiment, the Fc region is modified by substituting the aspartate residue at position 265 with an alanine residue, the asparagine residue at position 297 with an alanine residue and the proline residue at position 329 with an alanine residue (D265A/N297A/P329A).

In one embodiment, the Fc region is modified by substituting the aspartate residue at position 265 with an asparagine residue, the asparagine residue at position 297 with an aspartate residue and the proline residue at position 329 with a glycine residue (D265N/N297D/P329G).

In one embodiment, the Fc region is modified by substituting the aspartate residue at position 265 with a glutamate residue, the asparagine residue at position 297 with an glutamine residue and the proline residue at position 329 with a serine residue (D265E/N297Q/P329S).

It will be appreciated that any of the modifications listed above can be combined to decrease FcγR binding.

In one embodiment, a CD2 binding molecule comprises an Fc domain in which one or both Fc regions comprise one or more modifications that decrease Fc binding to FcγRIIIa without affecting the Fc's binding to FcγRII.

In one embodiment, the Fc region is modified by substituting the serine residue at position 239 with an alanine residue (S239A).

In one embodiment, the Fc region is modified by substituting the glutamic acid residue at position 269 with an alanine residue (E269A).

In one embodiment, the Fc region is modified by substituting the glutamic acid residue at position 293 with an alanine residue (E293A).

In one embodiment, the Fc region is modified by substituting the tyrosine residue at position 296 with a phenylalanine residue (Y296F).

In one embodiment, the Fc region is modified by substituting the valine residue at position 303 with an alanine residue (V303A).

In one embodiment, the Fc region is modified by substituting the alanine residue at position 327 with a glycine residue (A327G).

In one embodiment, the Fc region is modified by substituting the lysine residue at position 338 with an alanine residue (K338A).

In one embodiment, the Fc region is modified by substituting the aspartic acid residue at position 376 with an alanine residue (D376A).

It will be appreciated that any of the modifications listed above can be combined to decrease FcγRIIIa binding.

Fc region variants with decreased FcR binding can be referred to as "FcγR ablation variants," "FcγR silencing variants" or "Fc knock out (FcKO or KO)" variants. For some therapeutic applications, it is desirable to reduce or remove the normal binding of an Fc domain to one or more or all of the Fcγ receptors (e.g., FcγR1, FcγRIIa, FcγRIIb, FcγRIIIa) to avoid additional mechanisms of action. That is, for example, in many embodiments, particularly in the use of MBMs that bind CD3 monovalently, it is generally desirable to ablate FcγRIIIa binding to eliminate or significantly reduce ADCC activity. In some embodiments, at least one of the Fc regions of the MBMs described herein comprises one or more Fcγ receptor ablation variants. In some embodiments, both of the Fc regions comprise one or more Fcγ receptor ablation variants. These ablation variants are depicted in Table 3, and each can be independently and optionally included or excluded, with some aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G, E233P/L234V/L235A/G236del, D265A/N297A/P329A, D265N/N297D/P329G, and D265E/N297Q/P329S ("del" connotes a deletion, e.g., G236del refers to a deletion of the glycine at position 236). It should be noted that the ablation variants referenced herein ablate FcγR binding but generally not FcRn binding.

TABLE 3

Ablation Variants

| Variant | Variant(s), cont. |
| --- | --- |
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | D265A/N297A/P329A |
| L328R | D265N/N297D/P329G |
| P329A | D265E/N297Q/P329S |
| P329H | |

In some embodiments, the MBMs of the present disclosure comprises a first Fc region and a second Fc region. In some embodiments, the first Fc region and/or the second Fc region can comprise the following mutations: E233P, L234V, L235A, G236del, and S267K.

The Fc domain of human IgG1 has the highest binding to the Fcγ receptors, and thus ablation variants can be used when the constant domain (or Fc domain) in the backbone of the heterodimeric antibody is IgG1.

Alternatively, or in addition to ablation variants in an IgG1 background, mutations at the glycosylation position 297, e.g., substituting the asparagine residue at position 297 with an alanine residue (N297A) or a glutamine residue (N297Q), can significantly ablate binding to FcγRIIIa, for example. Human IgG2 and IgG4 have naturally reduced binding to the Fcγ receptors, and thus those backbones can be used with or without the ablation variants.

7.6.1.2. Fc Domains with Altered Complement Binding

The CD2 binding molecules can comprise an Fc domain in which one or both Fc regions comprises one or more modifications that alter Fc binding to complement. Altered complement binding can be increased binding or decreased binding.

In one embodiment, the Fc region comprises one or more modifications which decrease its binding to C1q. Initiation of the classical complement pathway starts with binding of hexameric C1q protein to the CH2 domain of antigen bound IgG and IgM.

In one embodiment, the CD2 binding molecule comprises an Fc domain in which one or both Fc regions comprises one or more modifications to decrease Fc binding to C1q.

In one embodiment, the Fc region is modified by substituting the leucine residue at position 234 with an alanine residue (L234A).

In one embodiment, the Fc region is modified by substituting the leucine residue at position 235 with an alanine residue (L235A).

In one embodiment, the Fc region is modified by substituting the leucine residue at position 235 with a glutamic acid residue (L235E).

In one embodiment, the Fc region is modified by substituting the glycine residue at position 237 with an alanine residue (G237A).

In one embodiment, the Fc region is modified by substituting the lysine residue at position 322 with an alanine residue (K322A).

In one embodiment, the Fc region is modified by substituting the proline residue at position 331 with an alanine residue (P331A).

In one embodiment, the Fc region is modified by substituting the proline residue at position 331 with a serine residue (P331S).

In one embodiment, a CD2 binding molecule comprises an Fc domain derived from IgG4. IgG4 has a naturally lower complement activation profile than IgG1, but also weaker binding of FcγR. Thus, in one embodiment, the CD2 binding molecule comprises an IgG4 Fc domain and also comprises one or more modifications that increase FcγR binding.

It will be appreciated that any of the modifications listed above can be combined to reduce C1q binding.

7.6.1.3. Fc Domains with Altered Disulfide Architecture

The CD2 binding molecule can include an Fc domain comprising one or more modifications to create and/or remove a cysteine residue. Cysteine residues have an important role in the spontaneous assembly of Fc-based multispecific binding molecules, by forming disulfide bridges between individual pairs of polypeptide monomers. Thus, by altering the number and/or position of cysteine residues, it is possible to modify the structure of the CD2 binding molecule to produce a protein with improved therapeutic properties.

A CD2 binding molecule of the present disclosure can comprise an Fc domain in which one or both Fc regions, e.g., both Fc regions, comprise a cysteine residue at position 309. In one embodiment, the cysteine residue at position 309 is created by a modification, e.g., for an Fc domain derived from IgG1, the leucine residue at position 309 is substituted with a cysteine residue (L3090), for an Fc domain derived from IgG2, the valine residue at position 309 is substituted with a cysteine residue (V3090).

In one embodiment, the Fc region is modified by substituting the valine residue at position 308 with a cysteine residue (V3080).

In one embodiment, two disulfide bonds in the hinge region are removed by mutating a core hinge sequence CPPC (SEQ ID NO: 726) to SPPS (SEQ ID NO: 731).

7.6.1.4. Fc Domains with Altered Glycosylation

In certain aspects, CD2 binding molecules with improved manufacturability are provided that comprise fewer glycosylation sites than a corresponding immunoglobulin. These proteins have less complex post translational glycosylation patterns and are thus simpler and less expensive to manufacture.

In one embodiment a glycosylation site in the CH2 domain is removed by substituting the asparagine residue at position 297 with an alanine residue (N297A) or a glutamine residue (N297Q). In addition to improved manufacturability, these aglycosyl mutants also reduce FcγR binding as described herein above.

In some embodiments, a CD2 binding molecule can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing a CD2 binding molecule in a host cell with altered glycosylation machinery. Cells with altered glycosylation machinery have been described in the art and can be used as host cells in which to express CD2 binding molecules to thereby produce CD2 binding molecules with altered glycosylation. For example, EP 1,176,195 by Hang et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, LecI3 cells, with reduced ability to attach fucose to Asn(297)-linked carbohydrates, also resulting in hypofucosylation of antibodies expressed in that host cell (see also Shields et al., 2002, J. Biol. Chem. 277:26733-26740). PCT Publication WO 99/54342 by Umana et al. describes cell lines engineered to express glycoprotein-modifying glycosyl transferases (e.g., beta(1,4)-N acetylglucosaminyltransferase III (GnTIII)) such that antibodies expressed in the engineered cell lines exhibit increased bisecting GlcNac structures which results in increased ADCC activity of the antibodies (see also Umana et al., Nat. Biotech. 17:176-180, 1999).

7.6.1.5. Fc Heterodimerization

Many multispecific molecule formats entail dimerization between two Fc regions that, unlike a native immunoglobulin, are operably linked to non-identical antigen-binding domains (or portions thereof, e.g., a VH or VH-CH1 of a Fab). Inadequate heterodimerization of two Fc regions to form an Fc domain has always been an obstacle for increasing the yield of desired multispecific molecules and represents challenges for purification. A variety of approaches available in the art can be used in for enhancing dimerization of Fc regions that might be present in the CD2 binding molecules (and particularly in the MBMs of the disclosure), for example as disclosed in EP 1870459A1; U.S. Pat. Nos. 5,582,996; 5,731,168; 5,910,573; 5,932,448; 6,833,441; 7,183,076; U.S. Patent Application Publication No. 2006204493A1; and PCT Publication No. WO2009/089004A1.

The present disclosure provides CD2 binding molecules comprising Fc heterodimers, i.e., Fc domains comprising heterologous, non-identical Fc regions. Heterodimerization strategies are used to enhance dimerization of Fc regions operably linked to different ABMs (or portions thereof, e.g., a VH or VH-CH1 of a Fab) and reduce dimerization of Fc regions operably linked to the same ABM or portion thereof. Typically, each Fc region in the Fc heterodimer comprises a CH3 domain of an antibody. The CH3 domains are derived from the constant region of an antibody of any isotype, class or subclass, and in some cases, of IgG (IgG1, IgG2, IgG3 and IgG4) class, as described in the preceding section.

Typically, the MBMs comprise other antibody fragments in addition to CH3 domains, such as, CH1 domains, CH2 domains, hinge domain, VH domain(s), VL domain(s), CDR(s), and/or antigen-binding fragments described herein. In some embodiments, the two hetero-polypeptides are two heavy chains forming a bispecific or multispecific molecules. Heterodimerization of the two different heavy chains at CH3 domains give rise to the desired antibody or antibody-like molecule, while homodimerization of identical heavy chains will reduce yield of the desired antibody or molecule. In an exemplary embodiment, the two or more hetero-polypeptide chains comprise two chains comprising CH3 domains and forming the molecules of any of the multispecific molecule formats described above of the present disclosure. In an embodiment, the two hetero-polypeptide chains comprising CH3 domains comprise modifications that favor heterodimeric association of the polypeptides, relative to unmodified chains. Various examples of modification strategies are provided below in Table 4 and Sections 7.6.1.5.1 to 7.6.1.5.7.

TABLE 4

Fc Heterodimerization Strategies

| NO. | STRATEGY | CH3 DOMAIN 1 | CH3 DOMAIN 2 | REFERENCES |
|---|---|---|---|---|
| Fc 1 | knobs-into-holes (Y-T) | T366Y | Y407T | Ridgway et al., 1996, Protein Eng 9: 617-21 |
| Fc 2 | knobs-into-holes (CW-CSAV) | S354C, T366W | Y349C, T366S, L368A, Y407V | Atwell et al., 1997, J Mol Biol. 270(1): 26-35; Merchant et al., 1998, Nat Biotechnol 16: 677-681 |
| Fc 3 | HA-TF | S364H, F405A | Y349T, T394F | Moore et al., 2011, MAbs 3(6): 546-57 |
| Fc 4 | ZW1 (VYAV-VLLW) | T350V, L351Y, F405A, Y407V | T350V, T366L, K392L, T394W | Von Kreudenstein et al., 2013, MAbs 5: 646-54 |
| Fc 5 | CH3 charge pairs (DD-KK) | K392D, K409D | E356K, D399K | Gunasekaran et al., 2010, J Biol Chem 285: 19637-46 |
| Fc 6 | IgG1 hingE, CH3 charge pairs (EEE-RRR) | IgG1: D221E, P228E, L368E | IgG1: D221R, P228R, K409R | Strop et al., 2012, J Mol Biol 420: 204-19 |
| Fc 7 | IgG2 hingE, CH3 charge pairs (EEE-RRRR) | IgG2: C223E, P228E, L368E | IgG2: C223R, E225R, P228R, K409R | Strop et al., 2012, J Mol Biol 420: 204-19 |
| Fc 8 | EW-RVT | K360E, K409W, | Q347R, D399V, F405T | Choi et al., 2013, Mol Cancer Ther 12: 2748-59 |
| Fc 9 | EW-RVTS-S | K360E, K409W, Y349C | Q347R, D399V, F405T, S354C | Choi et al., 2015, Mol Immunol 65: 377-83 |
| Fc 10 | Biclonic | 366K (+351K) | 351D or E or D at 349, 368, 349, or 349 + 355 | Geuijen et al., 2014, Journal of Clinical Oncology 32: suppl: 560 |
| Fc 11 | DuoBody (L-R) | F405L | K409R | Labrijn et al., 2013, Proc Natl Acad Sci USA 110: 5145-50 |
| Fc 12 | SEEDbody | IgG/A chimera | IgG/A chimera | Davis et al., 2010, Protein Eng Des Sel 23: 195-202 |
| Fc 13 | BEAT | residues from TCRα interface | residues from TCRβ interface | Moretti et al., 2013, BMC Proceedings 7(Suppl 6): O9 |
| Fc 14 | 7.8.60 (DMA-RRVV) | K360D, D399M, Y407A | E345R, Q347R, T366V, K409V | Leaver-Fey et al., Structure 24: 641-51 |
| Fc 15 | 20.8.34 (SYMV-GDQA) | Y349S, K370Y, T366M, K409V | E356G, E357D, S364Q, Y407A | Leaver-Fey et al., Structure 24: 641-51 |
| Fc 16 | Skew variant 12757 | None | None | FIG. 34 of US 2016/0355600 |

TABLE 4-continued

Fc Heterodimerization Strategies

| NO. | STRATEGY | CH3 DOMAIN 1 | CH3 DOMAIN 2 | REFERENCES |
|---|---|---|---|---|
| Fc 17 | Skew variant 12758 | L368D, K370S | S364K | FIG. 34 of US 2016/0355600 |
| Fc 18 | Skew variant 12759 | L368D, K370S | S364K, E357L | FIG. 34 of US 2016/0355600 |
| Fc 19 | Skew variant 12760 | L368D, K370S | S364K, E357Q | FIG. 34 of US 2016/0355600 |
| Fc 20 | Skew variant 12761 | T411E, K360E, Q362E | D401K | FIG. 34 of US 2016/0355600 |
| Fc 21 | Skew variant 12496 | L368E, K370S | S364K | FIG. 34 of US 2016/0355600 |
| Fc 22 | Skew variant 12511 | K370S | S364K | FIG. 34 of US 2016/0355600 |
| Fc 23 | Skew variant 12840 | L368E, K370S | S364K, E357Q | FIG. 34 of US 2016/0355600 |
| Fc 24 | Skew variant 12841 | K370S | S364K, E357Q | FIG. 34 of US 2016/0355600 |
| Fc 25 | Skew variant 12894 | L368E, K370S | S364K | FIG. 34 of US 2016/0355600 |
| Fc 26 | Skew variant 12895 | K370S | S364K | FIG. 34 of US 2016/0355600 |
| Fc 27 | Skew variant 12896 | L368E, K370S | S364K, E357Q | FIG. 34 of US 2016/0355600 |
| Fc 28 | Skew variant 12901 | K370S | S364K, E357Q | FIG. 34 of US 2016/0355600 |
| Fc 29 | pI_ISO(−) | I199T, N203D, K274Q, R355Q, N384S, K392N, V397M, Q419E, DEL447 | | FIG. 31 of US 2016/0355600 |
| Fc 30 | pI_(−)_Isosteric_A | N208D, Q295E, N384D, Q418E, N421D | | FIG. 31 of US 2016/0355600 |
| Fc 31 | pI_(−)_isosteric_B | N208D, Q295E, Q418E, N421D | | FIG. 31 of US 2016/0355600 |
| Fc 32 | pI_ISO(+RR) | Q196K, I199T, P217R, P228R, N276K | | FIG. 31 of US 2016/0355600 |
| Fc 33 | pI_ISO(+) | Q196K, I199T, N276K | | FIG. 31 of US 2016/0355600 |
| Fc 34 | pI_(+) isosteric_A | E269Q, E272Q, E283Q, E357Q, | | FIG. 31 of US 2016/0355600 |
| Fc 35 | pI_(+)_isosteric_B | E269Q, E272Q, E283Q | | FIG. 31 of US 2016/0355600 |
| Fc 36 | pI_(+) isosteric_E269Q, E272Q | E269Q, E272Q | | FIG. 31 of US 2016/0355600 |
| Fc 37 | pI_(+)_isosteric_E269Q, E283Q | E269Q, E283Q | | FIG. 31 of US 2016/0355600 |
| Fc 38 | pI_(+) isosteric_E2720, E283Q | E272Q, E283Q | | FIG. 31 of US 2016/0355600 |
| Fc 39 | pI_(+)_isosteric_E269Q | E269Q | | FIG. 31 of US 2016/0355600 |
| Fc 40 | Heterodimerization | F405A | T394F | FIG. 30A of US 2016/0355600 |
| Fc 41 | Heterodimerization | S364D | Y349K | FIG. 30A of US 2016/0355600 |
| Fc 42 | Heterodimerization | S364E | L368K | FIG. 30A of US 2016/0355600 |
| Fc 43 | Heterodimerization | S364E | Y349K | FIG. 30A of US 2016/0355600 |
| Fc 44 | Heterodimerization | S364F | K370G | FIG. 30A of US 2016/0355600 |
| Fc 45 | Heterodimerization | S364H | Y349K | FIG. 30A of US 2016/0355600 |
| Fc 46 | Heterodimerization | S364H | Y349T | FIG. 30A of US 2016/0355600 |
| Fc 47 | Heterodimerization | S364Y | K370G | FIG. 30A of US 2016/0355600 |
| Fc 48 | Heterodimerization | T411K | K370E | FIG. 30A of US 2016/0355600 |
| Fc 49 | Heterodimerization | V397S, F405A | T394F | FIG. 30A of US 2016/0355600 |
| Fc 50 | Heterodimerization | K370R, T411K | K370E, T411E | FIG. 30A of US 2016/0355600 |
| Fc 51 | Heterodimerization | L351E, S364D | Y349K, L351K | FIG. 30A of US 2016/0355600 |

TABLE 4-continued

Fc Heterodimerization Strategies

| NO. | STRATEGY | CH3 DOMAIN 1 | CH3 DOMAIN 2 | REFERENCES |
|---|---|---|---|---|
| Fc 52 | Heterodimerization | L351E, S364E | Y349K, L351K | FIG. 30A of US 2016/0355600 |
| Fc 53 | Heterodimerization | L351E, T366D | L351K, T366K | FIG. 30A of US 2016/0355600 |
| Fc 54 | Heterodimerization | P395T, V397S, F405A | T394F | FIG. 30A of US 2016/0355600 |
| Fc 55 | Heterodimerization | S364D, K370G | S364Y, K370R | FIG. 30A of US 2016/0355600 |
| Fc 56 | Heterodimerization | S364D, T394F | Y349K, F405A | FIG. 30A of US 2016/0355600 |
| Fc 57 | Heterodimerization | S364E, F405A | Y349K, T394F | FIG. 30A of US 2016/0355600 |
| Fc 58 | Heterodimerization | S364E, F405S | Y349K, T394Y | FIG. 30A of US 2016/0355600 |
| Fc 59 | Heterodimerization | S364E, T411E | Y349K, D401K | FIG. 30A of US 2016/0355600 |
| Fc 60 | Heterodimerization | S364H, D401K | Y349T, T411E | FIG. 30A of US 2016/0355600 |
| Fc 61 | Heterodimerization | S364H, F405A | Y349T, T394F | FIG. 30A of US 2016/0355600 |
| Fc 62 | Heterodimerization | S364H, T394F | Y349T, F405A | FIG. 30A of US 2016/0355600 |
| Fc 63 | Heterodimerization | Y349C, S364E | Y349K, S354C | FIG. 30A of US 2016/0355600 |
| Fc 64 | Heterodimerization | L351E, S364D, F405A | Y349K, L351K, T394F | FIG. 30A of US 2016/0355600 |
| Fc 65 | Heterodimerization | L351K, S364H, D401K | Y349T, L351E, T411E | FIG. 30A of US 2016/0355600 |
| Fc 66 | Heterodimerization | S364E, T411E, F405A | Y349K, T394F, D401K | FIG. 30A of US 2016/0355600 |
| Fc 67 | Heterodimerization | S364H, D401K, F405A | Y349T, T394F, T411E | FIG. 30A of US 2016/0355600 |
| Fc 68 | Heterodimerization | S364H, F405A, T411E | Y349T, T394F, D401K | FIG. 30A of US 2016/0355600 |
| Fc 69 | Heterodimerization | T411E, K360E, N390D | D401K | FIG. 30C of US 2016/0355600 |
| Fc 70 | Heterodimerization | T411E, Q362E, N390D | D401K | FIG. 30C of US 2016/0355600 |
| Fc 71 | Heterodimerization | T411E, Q347R | D401K, K360D | FIG. 30C of US 2016/0355600 |
| Fc 72 | Heterodimerization | T411E, Q347R | D401K, K360E | FIG. 30C of US 2016/0355600 |
| Fc 73 | Heterodimerization | T411E, K360 | D401K, Q347K | FIG. 30C of US 2016/0355600 |
| Fc 74 | Heterodimerization | T411E, K360D | D401K, Q347R | FIG. 30C of US 2016/0355600 |
| Fc 75 | Heterodimerization | T411E, K360E | D401K, Q347K | FIG. 30C of US 2016/0355600 |
| Fc 76 | Heterodimerization | T411E, K360E | D401K, Q347R | FIG. 30C of US 2016/0355600 |
| Fc 77 | Heterodimerization | T411E, S364K | D401K, K370S | FIG. 30C of US 2016/0355600 |
| Fc 78 | Heterodimerization | T411E, K370S | D401K, S364K | FIG. 30C of US 2016/0355600 |
| Fc 79 | Heterodimerization | Q347E | E357Q | FIG. 30C of US 2016/0355600 |
| Fc 80 | Heterodimerization | Q347E | E357Q, Q362K | FIG. 30C of US 2016/0355600 |
| Fc 81 | Heterodimerization | K360D, Q362E | Q347R | FIG. 30C of US 2016/0355600 |
| Fc 82 | Heterodimerization | K360D, Q362E | D401K | FIG. 30C of US 2016/0355600 |
| Fc 83 | Heterodimerization | K360D, Q362E | Q347R, D401K | FIG. 30C of US 2016/0355600 |
| Fc 84 | Heterodimerization | K360E, Q362E | Q347R | FIG. 30C of US 2016/0355600 |
| Fc 85 | Heterodimerization | K360E, Q362E | D401K | FIG. 30C of US 2016/0355600 |
| Fc 86 | Heterodimerization | K360E, Q362E | Q347R, D401K | FIG. 30C of US 2016/0355600 |
| Fc 87 | Heterodimerization | Q362E, N390D | D401K | FIG. 30C of US 2016/0355600 |
| Fc 88 | Heterodimerization | Q347E, K360D | D401N | FIG. 30C of US 2016/0355600 |
| Fc 89 | Heterodimerization | K360D | Q347R, N390K | FIG. 30C of US 2016/0355600 |

TABLE 4-continued

Fc Heterodimerization Strategies

| NO. | STRATEGY | CH3 DOMAIN 1 | CH3 DOMAIN 2 | REFERENCES |
|---|---|---|---|---|
| Fc 90 | Heterodimerization | K360D | N390K, D401N | FIG. 30C of US 2016/0355600 |
| Fc 91 | Heterodimerization | K360E | Y349H | FIG. 30C of US 2016/0355600 |
| Fc 92 | Heterodimerization | K370S, Q347E | S364K | FIG. 30C of US 2016/0355600 |
| Fc 93 | Heterodimerization | K370S, E357L | S364K | FIG. 30C of US 2016/0355600 |
| Fc 94 | Heterodimerization | K370S, E357Q | S364K | FIG. 30C of US 2016/0355600 |
| Fc 95 | Heterodimerization | K370S, Q347E, E357L | S364K | FIG. 30C of US 2016/0355600 |
| Fc 96 | Heterodimerization | K370S, Q347E, E357Q | S364K | FIG. 30C of US 2016/0355600 |
| Fc 97 | Heterodimerization | L368D, K370S, Q347E | S364K | FIG. 30D of US 2016/0355600 |
| Fc 98 | Heterodimerization | L368D, K370S, E357L | S364K | FIG. 30D of US 2016/0355600 |
| Fc 99 | Heterodimerization | L368D, K370S, E357Q | S364K | FIG. 30D of US 2016/0355600 |
| Fc 100 | Heterodimerization | L368D, K370S, Q347E, E357L | S364K | FIG. 30D of US 2016/0355600 |
| Fc 101 | Heterodimerization | L368D, K370S, Q347E, E357Q | S364K | FIG. 30D of US 2016/0355600 |
| Fc 102 | Heterodimerization | L368E, K370S, Q347E | S364K | FIG. 30D of US 2016/0355600 |
| Fc 103 | Heterodimerization | L368E, K370S, E357L | S364K | FIG. 30D of US 2016/0355600 |
| Fc 104 | Heterodimerization | L368E, K370S, E357Q | S364K | FIG. 30D of US 2016/0355600 |
| Fc 105 | Heterodimerization | L368E, K370S, Q347E, E357L | S364K | FIG. 30D of US 2016/0355600 |
| Fc 106 | Heterodimerization | L368E, K370S, Q347E, E357Q | S364K | FIG. 30D of US 2016/0355600 |
| Fc 107 | Heterodimerization | L368D, K370T, Q347E | S364K | FIG. 30D of US 2016/0355600 |
| Fc 108 | Heterodimerization | L368D, K370T, E357L | S364K | FIG. 30D of US 2016/0355600 |
| Fc 109 | Heterodimerization | L368D, K370T, E357Q | S364K | FIG. 30D of US 2016/0355600 |
| Fc 110 | Heterodimerization | L368D, K370T, Q347E, E357L | S364K | FIG. 30D of US 2016/0355600 |
| Fc 111 | Heterodimerization | L368D, K370T, Q347E, E357Q | S364K | FIG. 30D of US 2016/0355600 |
| Fc 112 | Heterodimerization | L368E, K370T, Q347E | S364K | FIG. 30D of US 2016/0355600 |
| Fc 113 | Heterodimerization | L368E, K370T, E357L | S364K | FIG. 30D of US 2016/0355600 |
| Fc 114 | Heterodimerization | L368E, K370T, E357Q | S364K | FIG. 30D of US 2016/0355600 |
| Fc 115 | Heterodimerization | L368E, K370T, Q347E, E357L | S364K | FIG. 30D of US 2016/0355600 |
| Fc 116 | Heterodimerization | L368E, K370T, Q347E, E357Q | S364K | FIG. 30D of US 2016/0355600 |
| Fc 117 | Heterodimerization | T411E, Q362E | D401K, T411K | FIG. 30D of US 2016/0355600 |
| Fc 118 | Heterodimerization | T411E, N390D | D401K, T411K | FIG. 30D of US 2016/0355600 |
| Fc 119 | Heterodimerization | T411E, Q362E | D401R, T411R | FIG. 30D of US 2016/0355600 |
| Fc 120 | Heterodimerization | T411E, N390D | D401R, T411R | FIG. 30D of US 2016/0355600 |
| Fc 121 | Heterodimerization | Y407T | T366Y | FIG. 30D of US 2016/0355600 |
| Fc 122 | Heterodimerization | F405A | T394W | FIG. 30D of US 2016/0355600 |
| Fc 123 | Heterodimerization | T366Y, F405A | T394W, Y407T | FIG. 30D of US 2016/0355600 |
| Fc 124 | Heterodimerization | T366S, L368A, Y407V | T366W | FIG. 30D of US 2016/0355600 |
| Fc 125 | Heterodimerization | T366S, L368A, Y407V, Y349C | T366W, S354C | FIG. 30D of US 2016/0355600 |
| Fc 126 | Heterodimerization | K392D, K409D | E356K, D399K | FIG. 30E of US 2016/0355600 |
| Fc 127 | Heterodimerization | K370D, K392D, K409D | E356K, E357K, D399K | FIG. 30E of US 2016/0355600 |

TABLE 4-continued

Fc Heterodimerization Strategies

| NO. | STRATEGY | CH3 DOMAIN 1 | CH3 DOMAIN 2 | REFERENCES |
|---|---|---|---|---|
| Fc 128 | Heterodimerization | I199T, N203D, K247Q, R355Q, N384S, K392N, V397M, Q419E, K447 | Q196K, L99T, P217R, P228R, N276K | FIG. 30E of US 2016/0355600 |
| Fc 129 | Heterodimerization | I199T, N203D, K247Q, R355Q, N384S, K392N, V397M, Q419E, K447 | Q196K, L99T, N276K | FIG. 30E of US 2016/0355600 |
| Fc 130 | Heterodimerization | N384S, K392N, V397M, Q419E | N276K | FIG. 30E of US 2016/0355600 |
| Fc 131 | Heterodimerization | D221E, P228E, L368E | D221R, P228R, K409R | FIG. 30E of US 2016/0355600 |
| Fc 132 | Heterodimerization | C220E, P228E, L368E | C220R, E224R, P228R, K409R | FIG. 30E of US 2016/0355600 |
| Fc 133 | Heterodimerization | F405L | K409R | FIG. 30E of US 2016/0355600 |
| Fc 134 | Heterodimerization | T366I, K392M, T394W | F405A, Y407V | FIG. 30E of US 2016/0355600 |
| Fc 135 | Heterodimerization | T366V, K409F | L351Y, Y407A | FIG. 30E of US 2016/0355600 |
| Fc 136 | Heterodimerization | T366A, K392E, K409F, T411E | D399R, S400R, Y407A | FIG. 30E of US 2016/0355600 |
| Fc 137 | Heterodimerization | L351K | L351E | FIG. 30E of US 2016/0355600 |
| Fc 138 | Heterodimerization | I199T, N203D, K247Q, R355Q, Q419E, K447 | Q196K, L199T, P217R, P228R, N276K | FIG. 30E of US 2016/0355600 |
| Fc 139 | Heterodimerization | I199T, N203D, K247Q, R355Q, Q419E, K447 | Q196K, I199T, N276K | FIG. 30E of US 2016/0355600 |
| Fc 140 | Heterodimerization | I199T, N203D, K274Q, R355Q, N384S, K392N, V397M, Q419E DEL447 | | FIG. 30E of US 2016/0355600 |
| Fc 141 | Heterodimerization | N208D, Q295E N384D, Q418E N421D | | FIG. 30E of US 2016/0355600 |
| Fc 142 | Heterodimerization | N208D, Q295E Q418E, N421D | | FIG. 30E of US 2016/0355600 |
| Fc 143 | Heterodimerization | Q196K, I199T P217R, P228R N276K | | FIG. 30E of US 2016/0355600 |
| Fc 144 | Heterodimerization | Q196K, I199T N276K | | FIG. 30E of US 2016/0355600 |
| Fc 145 | Heterodimerization | E269Q, E272Q E283Q, E357Q | | FIG. 30E of US 2016/0355600 |
| Fc 146 | Heterodimerization | E269Q, E272Q E283Q, | | FIG. 30E of US 2016/0355600 |
| Fc 147 | Heterodimerization | E269Q, E272Q | | FIG. 30E of US 2016/0355600 |
| Fc 148 | Heterodimerization | E269Q, E283Q | | FIG. 30E of US 2016/0355600 |
| Fc 149 | Heterodimerization | E272Q, E283Q | | FIG. 30E of US 2016/0355600 |
| Fc 150 | Heterodimerization | E269Q | | FIG. 30E of US 2016/0355600 |

Exemplary pairs of heterologous, non-identical Fc sequences that can pair to form a Fc heterodimer, and which can be included in a CD2 binding molecule of the disclosure, include (i) SEQ ID NO:1335 and SEQ ID NO:1336, and (ii) SEQ ID NO:1335 and SEQ ID NO:1337.

(SEQ ID NO: 1335)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVCTLPPSREEMTKNQVSLSCAVK

GFYPSDIAVEWESNGQPENNYKTTPPVLDSDGSFFLVSKLTVDKSRWQQG

NVFSCSVMHEALHNHYTQKSLSLSPGK (SEQ ID NO: 1336)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPCREEMTKNQVSLWCLVK

-continued

```
GFYPSDIAVEWESNGQPENNYKTTPPVLDSDGSFFLYSKLTVDKSRWQQG

NVFSCSVMHEALHNHYTQKSLSLSPGK
```

(SEQ ID NO: 1337)
```
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPCREEMTKNQVSLWCLVK

GFYPSDIAVEWESNGQPENNYKTTPPVLDSDGSFFLYSKLTVDKSRWQQG

NVFSCSVMHEALHNRYTQKSLSLSPGK
```

An Fc region having an amino acid sequence of one of SEQ ID NOS: 1335-1337 can be modified to include one or more of the substitutions described in Section 7.6.1 (including its subparts), for example to include the substitution(s) corresponding to an ablation variant set forth in Table 3. In some embodiments, a CD2 binding molecule comprises an Fc region having an amino acid sequence of one of SEQ ID NOs:1335-1337 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 (EU numbering), for example mutation(s) described in Section 7.6.1 (including its subparts). For example, a CD2 binding molecule can comprise an Fc region having an amino acid sequence of SEQ ID NO:1335 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 and/or an Fc region having an amino acid sequence of SEQ ID NO:1336 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332 and/or an Fc region having an amino acid sequence of SEQ ID NO:1337 with a mutation at 1, 2, 3, 4, 5, 6, or more than 6 of positions 233, 234, 235, 236, 237, 239, 265, 266, 267, 268, 269, 297, 299, 322, 327, 328, 329, 330, 331 and 332.

7.6.1.5.1. Steric Variants

CD2 binding molecules can comprise one or more, e.g., a plurality, of modifications to one or more of the constant domains of an Fc domain, e.g., to the CH3 domains. In one example, a CD2 binding molecule of the present disclosure comprises two polypeptides that each comprise a heavy chain constant domain of an antibody, e.g., a CH2 or CH3 domain. In an example, the two heavy chain constant domains, e.g., the CH2 or CH3 domains of the CD2 binding molecule comprise one or more modifications that allow for a heterodimeric association between the two chains. In one aspect, the one or more modifications are disposed on CH2 domains of the two heavy chains. In one aspect, the one or more modifications are disposed on CH3 domains of at least two polypeptides of the CD2 binding molecule.

One mechanism for Fc heterodimerization is generally referred to as “knobs and holes” or “knobs-into-holes”. These terms refer to amino acid mutations that create steric influences to favor formation of Fc heterodimers over Fc homodimers, as described in, e.g., Ridgway et al., 1996, Protein Engineering 9(7):617; Atwell et al., 1997, J. Mol. Biol. 270:26; U.S. Pat. No. 8,216,805. Knob-in-hole mutations can be combined with other strategies to improve heterodimerization.

In one aspect, the one or more modifications to a first polypeptide of the CD2 binding molecule comprising a heavy chain constant domain can create a “knob” and the one or more modifications to a second polypeptide of the CD2 binding molecule creates a “hole,” such that heterodimerization of the polypeptide of the CD2 binding molecule comprising a heavy chain constant domain causes the “knob” to interface (e.g., interact, e.g., a CH2 domain of a first polypeptide interacting with a CH2 domain of a second polypeptide, or a CH3 domain of a first polypeptide interacting with a CH3 domain of a second polypeptide) with the “hole.” The knob projects from the interface of a first polypeptide of the CD2 binding molecule comprising a heavy chain constant domain and is therefore positionable in a compensatory “hole” in the interface with a second polypeptide of the CD2 binding molecule comprising a heavy chain constant domain so as to stabilize the heteromultimer, and thereby favor heteromultimer formation over homomultimer formation, for example. The knob can exist in the original interface or can be introduced synthetically (e.g. by altering nucleic acid encoding the interface). The import residues for the formation of a knob are generally naturally occurring amino acid residues and can be selected from arginine (R), phenylalanine (F), tyrosine (Y) and tryptophan (W). In some cases, tryptophan and tyrosine are selected. In an embodiment, the original residue for the formation of the protuberance has a small side chain volume, such as alanine, asparagine, aspartic acid, glycine, serine, threonine or valine.

A “hole” comprises at least one amino acid side chain which is recessed from the interface of a second polypeptide of the CD2 binding molecule comprising a heavy chain constant domain and therefore accommodates a corresponding knob on the adjacent interfacing surface of a first polypeptide of the CD2 binding molecule comprising a heavy chain constant domain. The hole can exist in the original interface or can be introduced synthetically (e.g. by altering nucleic acid encoding the interface). The import residues for the formation of a hole are usually naturally occurring amino acid residues and are in some embodiments selected from alanine (A), serine (S), threonine (T) and valine (V). In one embodiment, the amino acid residue is serine, alanine or threonine. In another embodiment, the original residue for the formation of the hole has a large side chain volume, such as tyrosine, arginine, phenylalanine or tryptophan.

In an embodiment, a first CH3 domain is modified at residue 366, 405 or 407 to create either a “knob” or a hole” (as described above), and the second CH3 domain that heterodimerizes with the first CH3 domain is modified at: residue 407 if residue 366 is modified in the first CH3 domain, residue 394 if residue 405 is modified in the first CH3 domain, or residue 366 if residue 407 is modified in the first CH3 domain to create a “hole” or “knob” complementary to the “knob” or “hole” of the first CH3 domain.

In another embodiment, a first CH3 domain is modified at residue 366, and the second CH3 domain that heterodimerizes with the first CH3 domain is modified at residues 366, 368 and/or 407, to create a “hole” or “knob” complementary to the “knob” or “hole” of the first CH3 domain. In one embodiment, the modification to the first CH3 domain introduces a tyrosine (Y) residue at position 366. In an embodiment, the modification to the first CH3 is T366Y. In one embodiment, the modification to the first CH3 domain introduces a tryptophan (W) residue at position 366. In an embodiment, the modification to the first CH3 is T366W. In some embodiments, the modification to the second CH3 domain that heterodimerizes with the first CH3 domain modified at position 366 (e.g., has a tyrosine (Y) or tryptophan (W) introduced at position 366, e.g., comprises the modification T366Y or T366W), comprises a modification at position 366, a modification at position 368 and a modification at position 407. In some embodiments, the modification at position 366 introduces a serine (S) residue, the modification at position 368 introduces an alanine (A), and the modification at position 407 introduces a valine (V). In some embodiments, the modifications comprise T366S, L368A and Y407V. In one embodiment, the first CH3 domain of the multispecific molecule comprises the modification T366Y, and the second CH3 domain that heterodimerizes with the first CH3 domain comprises the modifications T366S, L368A and Y407V, or vice versa. In one embodiment, the first CH3 domain of the multispecific molecule comprises the modification T366W, and the second CH3 domain that heterodimerizes with the first CH3 domain comprises the modifications T366S, L368A and Y407V, or vice versa.

Additional steric or "skew" (e.g., knob in hole) modifications are described in PCT publication no. WO2014/145806 (for example, FIG. 3, FIG. 4 and FIG. 12 of WO2014/145806), PCT publication no. WO2014/110601, and PCT publication no. WO 2016/086186, WO 2016/086189, WO 2016/086196 and WO 2016/182751. An example of a KIH variant comprises a first constant chain comprising a L368D and a K370S modification, paired with a second constant chain comprising a S364K and E357Q modification.

Additional knob in hole modification pairs suitable for use in any of the CD2 binding molecules of the present disclosure are further described in, for example, WO1996/027011, and Merchant et al., 1998, Nat. Biotechnol., 16:677-681.

In further embodiments, the CH3 domains can be additionally modified to introduce a pair of cysteine residues. Without being bound by theory, it is believed that the introduction of a pair of cysteine residues capable of forming a disulfide bond provide stability to heterodimerized CD2 binding molecules, e.g., MBMs, comprising paired CH3 domains. In some embodiments, the first CH3 domain comprises a cysteine at position 354, and the second CH3 domain that heterodimerizes with the first CH3 domain comprises a cysteine at position 349. In some embodiments, the first CH3 domain comprises a cysteine at position 354 (e.g., comprises the modification S354C) and a tyrosine (Y) at position 366 (e.g., comprises the modification T366Y), and the second CH3 domain that heterodimerizes with the first CH3 domain comprises a cysteine at position 349 (e.g., comprises the modification Y349C), a serine at position 366 (e.g., comprises the modification T366S), an alanine at position 368 (e.g., comprises the modification L368A), and a valine at position 407 (e.g., comprises the modification Y407V). In some embodiments, the first CH3 domain comprises a cysteine at position 354 (e.g., comprises the modification S354C) and a tryptophan (W) at position 366 (e.g., comprises the modification T366W), and the second CH3 domain that heterodimerizes with the first CH3 domain comprises a cysteine at position 349 (e.g., comprises the modification Y349C), a serine at position 366 (e.g., comprises the modification T366S), an alanine at position 368 (e.g., comprises the modification L368A), and a valine at position 407 (e.g., comprises the modification Y407V).

An additional mechanism that finds use in the generation of heterodimers is sometimes referred to as "electrostatic steering" as described in Gunasekaran et al., 2010, J. Biol. Chem. 285(25):19637. This is sometimes referred to herein as "charge pairs". In this embodiment, electrostatics are used to skew the formation towards heterodimerization. As a skilled artisan will appreciate, these can also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R and C220E/P228E/368E paired with C220R/E224R/P228R/K409R.

Additional variants that can be combined with other variants, optionally and independently in any amount, such as pI variants outlined herein or other steric variants that are shown in FIG. 37 of US 2012/0149876.

In some embodiments, the steric variants outlined herein can be optionally and independently incorporated with any pI variant (or other variants such as Fc variants, FcRn variants) into one or both Fc regions, and can be independently and optionally included or excluded from the CD2 binding molecules of the disclosure.

A list of suitable skew variants is found in Table 5 showing some pairs of particular utility in many embodiments. Of particular use in many embodiments are the pairs of sets including, but not limited to, S364K/E357Q:L368D/K370S; L368D/K370S:S364K; L368E/K370S:S364K; T411T/E360E/Q362E:D401K; L368D/K370S:S364K/E357L; and K370S:S364K/E357Q. In terms of nomenclature, the pair "S364K/E357Q:L368D/K370S" means that one of the Fc regions has the double variant set S364K/E357Q and the other has the double variant set L368D/K370S.

TABLE 5

Exemplary skew variants

| Fc region 1 | Fc region 2 |
| --- | --- |
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |

TABLE 5-continued

Exemplary skew variants

| Fc region 1 | Fc region 2 |
|---|---|
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |
| K392D/K409D | E356K/D399K |
| K370D/K392D/K409D | E356K/E357K/D399K |
| I199T/N203D/K247Q/R355Q/N384S/ K392N/V397M/Q419E/K447_ | Q196K/I199T/P217R/P228R/N276K |
| I199T/N203D/K247Q/R355Q/N384S/ K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |

TABLE 5-continued

| Exemplary skew variants | |
|---|---|
| Fc region 1 | Fc region 2 |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |
| K392D/K409D | E356K/D399K |
| K370D/K392D/K409D | E356K/E357K/D399K |
| I199T/N203D/K247Q/R355Q/N384S/K392NA/Q397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| Q295E N384D Q418E N421D | |
| N208D Q295E Q418E N421D | |
| Q295E Q418E N421D | |
| Q196K I199T P217R P228R N276K | |
| Q196K I199T N276K | |

TABLE 5-continued

Exemplary skew variants

| Fc region 1 | Fc region 2 |
|---|---|
| E269Q E272Q E283Q E357Q | |
| E269Q E272Q E283Q | |
| E269Q E272Q | |
| E269Q E283Q | |
| E272Q E283Q | |
| E269Q | |

In some embodiments, a CD2 binding molecule comprises a first Fc region and a second Fc region. In some embodiments, the first Fc region comprises the following mutations: L368D and K370S, and the second Fc region comprises the following mutations: S364K and E357Q. In some embodiments, the first Fc region comprises the following mutations: S364K and E357Q, and the second Fc region comprises the following mutations: L368D and K370S.

7.6.1.5.2. Alternative Knob and Hole: IgG Heterodimerization

Heterodimerization of polypeptide chains of a CD2 binding molecule comprising paired CH3 domains can be increased by introducing one or more modifications in a CH3 domain which is derived from the IgG1 antibody class. In an embodiment, the modifications comprise a K409R modification to one CH3 domain paired with F405L modification in the second CH3 domain. Additional modifications can also, or alternatively, be at positions 366, 368, 370, 399, 405, 407, and 409. In some cases, heterodimerization of polypeptides comprising such modifications is achieved under reducing conditions, e.g., 10-100 mM 2-MEA (e.g., 25, 50, or 100 mM 2-MEA) for 1-10, e.g., 1.5-5, e.g., 5, hours at 25-37 C, e.g., 25 C or 37 C.

The amino acid replacements described herein can be introduced into the CH3 domains using techniques which are well known (see, e.g., McPherson, ed., 1991, Directed Mutagenesis: a Practical Approach; Adelman et al., 1983, DNA, 2:183).

The IgG heterodimerization strategy is further described in, for example, WO2008/119353, WO2011/131746, and WO2013/060867.

In any of the embodiments described in this Section, the CH3 domains can be additionally modified to introduce a pair of cysteine residues as described in Section 7.6.1.3.

7.6.1.5.3. pI (Isoelectric Point) Variants

In general, as will be appreciated by a skilled artisan, there are two general categories of pI variants: those that increase the pI of the protein (basic changes) and those that decrease the pI of the protein (acidic changes). As described herein, all combinations of these variants can be done: one Fc region can be wild type, or a variant that does not display a significantly different pI from wild-type, and the other can be either more basic or more acidic. Alternatively, each Fc region is changed, one to more basic and one to more acidic.

Exemplary combinations of pI variants are shown in Table 6. As outlined herein and shown in Table 6, these changes are shown relative to IgG1, but all isotypes can be altered this way, as well as isotype hybrids. In the case where the heavy chain constant domain is from IgG2-4, R133E and R133Q can also be used.

TABLE 6

Exemplary pI Variant Combinations

| Variant constant region | Substitutions |
|---|---|
| pI_ISO(−) | I199T N203D K274Q R355Q N384S K392N V397M Q419E DEL447 |
| pI_(−)_isosteric_A | N208D Q295E N384D Q418E N421D |
| pI_(−)_isosteric A-Fc only | Q295E N384D Q418E N421D |
| pI_(−)_isosteric_B | N208D Q295E Q418E N421D |
| pI_(−)_isosteric_B-Fc only | Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

In one embodiment, for example in the FIG. 1B-1W, FIG. 1Y-1AH, FIG. 2B-2L, and FIG. 2N-2V formats, a combination of pI variants has one Fc region (the negative Fab side) comprising 208D/295E/384D/418E/421D variants (N208D/Q295E/N384D/Q418E/N421D when relative to human IgG1) and a second Fc region (the positive scFv side) comprising a positively charged scFv linker, e.g., L36 (described in Section 7.6.3). However, as will be appreciated by a skilled artisan, the first Fc region includes a CH1 domain, including position 208. Accordingly, in constructs that do not include a CH1 domain (for example for MBMs that do not utilize a CH1 domain as one of the domains, for example in a format depicted in FIG. 2K), a negative pI variant Fc set can include 295E/384D/418E/421D variants (Q295E/N384D/Q418E/N421D when relative to human IgG1).

In some embodiments, a first Fc region has a set of substitutions from Table 6 and a second Fc region is connected to a charged linker (e.g., selected from those described in Section 7.6.3).

In some embodiments, the CD2 binding molecule of the present disclosure comprises a first Fc region and a second Fc region. In some embodiments, the first Fc region comprises the following mutations: N208D, Q295E, N384D, Q418E, and N421D. In some embodiments, the second Fc region comprises the following mutations: N208D, Q295E, N384D, Q418E, and N421D.

7.6.1.5.4. Isotopic Variants

In addition, many embodiments of the disclosure rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting Fc region is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, as is further described below.

In addition, by pI engineering both the heavy and light constant domains of a CD2 binding molecule comprising two half antibodies, significant changes in each half antibody can be seen. Having the pIs of the two half antibodies differ by at least 0.5 can allow separation by ion exchange chromatography or isoelectric focusing, or other methods sensitive to isoelectric point.

7.6.1.5.5. Calculating pI

The pI of a half antibody comprising an Fc region and an ABM or ABM chain can depend on the pI of the variant heavy chain constant domain and the pI of the total half antibody, including the variant heavy chain constant domain and ABM or ABM chain. Thus, in some embodiments, the change in pI is calculated on the basis of the variant heavy chain constant domain, using the chart in the FIG. 19 of US Pub. 2014/0370013. As discussed herein, which half antibody to engineer is generally decided by the inherent pI of the half antibodies. Alternatively, the pI of each half antibody can be compared.

7.6.1.5.6. pI Variants that Also Confer Better FcRn In Vivo Binding

In the case where a pI variant decreases the pI of an Fc region, it can have the added benefit of improving serum retention in vivo.

pI variant Fc regions are believed to provide longer half-lives to antigen binding molecules in vivo, because binding to FcRn at pH 6 in an endosome sequesters the Fc (Ghetie and Ward, 1997, Immunol Today. 18(12): 592-598). The endosomal compartment then recycles the Fc to the cell surface. Once the compartment opens to the extracellular space, the higher pH~7.4, induces the release of Fc back into the blood. In mice, Dall'Acqua et al. showed that Fc mutants with increased FcRn binding at pH 6 and pH 7.4 actually had reduced serum concentrations and the same half life as wild-type Fc (Dall'Acqua et al. 2002, J. Immunol. 169: 5171-5180). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

It has been suggested that antibodies with variable regions that have lower isoelectric points can also have longer serum half-lives (Igawa et al., 2010, PEDS. 23(5): 385-392). However, the mechanism of this is still poorly understood. Moreover, variable regions differ from antibody to antibody. Constant region variants with reduced pI and extended half-life would provide a more modular approach to improving the pharmacokinetic properties of CD2 binding molecules, as described herein.

7.6.1.5.7. Polar Bridge

Heterodimerization of polypeptide chains of CD2 binding molecules, e.g., MBMs, comprising an Fc domain can be increased by introducing modifications based on the "polar-bridging" rationale, which is to make residues at the binding interface of the two polypeptide chains to interact with residues of similar (or complimentary) physical property in the heterodimer configuration, while with residues of different physical property in the homodimer configuration. In particular, these modifications are designed so that, in the heterodimer formation, polar residues interact with polar residues, while hydrophobic residues interact with hydrophobic residues. In contrast, in the homodimer formation, residues are modified so that polar residues interact with hydrophobic residues. The favorable interactions in the heterodimer configuration and the unfavorable interactions in the homodimer configuration work together to make it more likely for Fc regions to form heterodimers than to form homodimers.

In an exemplary embodiment, the above modifications are generated at one or more positions of residues 364, 368, 399, 405, 409, and 411 of a CH3 domain.

In some embodiments, one or more modifications selected from the group consisting of S364L, T366V, L368Q, N399K, F405S, K409F and R411K are introduced into one of the two CH3 domains. One or more modifications selected from the group consisting of Y407F, K409Q and T411N can be introduced into the second CH3 domain.

In another embodiment, one or more modifications selected from the group consisting of S364L, T366V, L368Q, D399K, F405S, K409F and T411K are introduced into one CH3 domain, while one or more modifications selected from the group consisting of Y407F, K409Q and T411D are introduced into the second CH3 domain.

In one exemplary embodiment, the original residue of threonine at position 366 of one CH3 domain is replaced by valine, while the original residue of tyrosine at position 407 of the other CH3 domain is replaced by phenylalanine.

In another exemplary embodiment, the original residue of serine at position 364 of one CH3 domain is replaced by leucine, while the original residue of leucine at position 368 of the same CH3 domain is replaced by glutamine.

In yet another exemplary embodiment, the original residue of phenylalanine at position 405 of one CH3 domain is replaced by serine and the original residue of lysine at position 409 of this CH3 domain is replaced by phenylalanine, while the original residue of lysine at position 409 of the other CH3 domain is replaced by glutamine.

In yet another exemplary embodiment, the original residue of aspartic acid at position 399 of one CH3 domain is replaced by lysine, and the original residue of threonine at position 411 of the same CH3 domain is replaced by lysine, while the original residue of threonine at position 411 of the other CH3 domain is replaced by aspartic acid.

The amino acid replacements described herein can be introduced into the CH3 domains using techniques which are well known (see, e.g., McPherson, ed., 1991, Directed Mutagenesis: a Practical Approach; Adelman et al., 1983, DNA, 2:183). The polar bridge strategy is described in, for example, WO2006/106905, WO2009/089004 and Gunasekaran et al., 2010, JBC 285:19637-19646.

Additional polar bridge modifications are described in, for example, PCT publication no. WO2014/145806 (for example, FIG. 6 of WO2014/145806), PCT publication no.

WO2014/110601, and PCT publication no. WO 2016/086186, WO 2016/086189, WO 2016/086196 and WO 2016/182751. An example of a polar bridge variant comprises a constant chain comprising a N208D, Q295E, N384D, Q418E and N421D modification.

In any of the embodiments described herein, the CH3 domains can be additionally modified to introduce a pair of cysteine residues as described in Section 7.6.1.3.

Additional strategies for enhancing heterodimerization are described in, for example, WO2016/105450, WO2016/086186, WO2016/086189, WO2016/086196, WO2016/141378, and WO2014/145806, and WO2014/110601. Any of the strategies can be employed in a CD2 binding molecule described herein.

7.6.1.6. Combination of Heterodimerization Variants and Other Fc Variants

As will be appreciated by a skilled artisan, all of the recited heterodimerization variants (including skew and/or pI variants) can be optionally and independently combined in any way, as long as the Fc regions of an Fc domain retain their ability to dimerize. In addition, all of these variants can be combined into any of the heterodimerization formats.

In the case of pI variants, while embodiments finding particular use are shown in the Table 6, other combinations can be generated, following the basic rule of altering the pI difference between two Fc regions in an Fc heterodimer to facilitate purification.

In addition, any of the heterodimerization variants, skew and pI, are also independently and optionally combined with Fc ablation variants, Fc variants, FcRn variants, as generally outlined herein.

In some embodiments, a particular combination of skew and pI variants that finds use in the present disclosure is T366S/L368A/Y407V:T366W (optionally including a bridging disulfide, T366S/L368A/Y407V/Y349C:T366W/S354C) with one Fc region comprising Q295E/N384D/Q418E/N481D and the other a positively charged scFv linker (when the format includes an scFv domain). As will be appreciated by a skilled artisan, the "knobs in holes" variants do not change pI, and thus can be used on either one of the Fc regions in an Fc heterodimer.

In some embodiments, first and second Fc regions that find use the present disclosure include the amino acid substitutions S364K/E357Q:L368D/K370S, where the first and/or second Fc region includes the ablation variant substitutions 233P/L234V/L235A/G236del/S267K, and the first and/or second Fc region comprises the pI variant substitutions N208D/Q295E/N384D/Q418E/N421D (pI_(-)_isosteric_A).

7.6.2. Hinge Regions

The CD2 binding molecules can also comprise hinge regions, e.g., connecting an antigen-binding domain to an Fc region. The hinge region can be a native or a modified hinge region. Hinge regions are typically found at the N-termini of Fc regions.

A native hinge region is the hinge region that would normally be found between Fab and Fc domains in a naturally occurring antibody. A modified hinge region is any hinge that differs in length and/or composition from the native hinge region. Such hinges can include hinge regions from other species, such as human, mouse, rat, rabbit, shark, pig, hamster, camel, llama or goat hinge regions. Other modified hinge regions can comprise a complete hinge region derived from an antibody of a different class or subclass from that of the heavy chain Fc region. Alternatively, the modified hinge region can comprise part of a natural hinge or a repeating unit in which each unit in the repeat is derived from a natural hinge region. In a further alternative, the natural hinge region can be altered by converting one or more cysteine or other residues into neutral residues, such as serine or alanine, or by converting suitably placed residues into cysteine residues. By such means the number of cysteine residues in the hinge region can be increased or decreased. This approach is described further in U.S. Pat. No. 5,677,425 by Bodmer et al. Altering the number of cysteine residues in a hinge region can, for example, facilitate assembly of light and heavy chains, or increase or decrease the stability of a CD2 binding molecule. Other modified hinge regions can be entirely synthetic and can be designed to possess desired properties such as length, cysteine composition and flexibility.

A number of modified hinge regions have been described for example, in U.S. Pat. No. 5,677,425, WO9915549, WO2005003170, WO2005003169, WO2005003170, WO9825971 and WO2005003171.

Examples of suitable hinge sequences are shown in Table 7.

TABLE 7

Hinge Sequences

| Hinge Name | Hinge Description | Hinge Sequence | SEQ ID NO: |
|---|---|---|---|
| H1 | Human IgA1 | VPSTPPTPSPSTPPTPSPS | 718 |
| H2 | Human IgA2 | VPPPPP | 719 |
| H3 | Human IgD | ESPKAQASSVPTAQPQAEGSLAKAT TAPATTRNTGRGGEEKKKEKEKEEQ EERETKTP | 720 |
| H4 | Human IgG1 | EPKSCDKTHTCPPCP | 721 |
| H5 | Human IgG2 | ERKCCVECPPCP | 722 |
| H6 | Human IgG3 | ELKTPLGDTTHTCPRCPEPKSCDTP PPCPRCPEPKSCDTPPPCPRCPEPK SCDTPPPCPRCP | 723 |
| H7 | Human IgG4 | ESKYGPPCPSCP | 724 |
| H8 | Human IgG4(P) | ESKYGPPCPPCP | 725 |
| H9 | Engineered v1 | CPPC | 726 |
| H10 | Engineered v2 | CPSC | 727 |
| H11 | Engineered v3 | CPRC | 728 |
| H12 | Engineered v4 | SPPC | 729 |
| H13 | Engineered v5 | CPPS | 730 |
| H14 | Engineered v6 | SPPS | 731 |
| H15 | Engineered v7 | DKTHTCAA | 732 |
| H16 | Engineered v8 | DKTHTCPPCPA | 733 |
| H17 | Engineered v9 | DKTHTCPPCPATCPPCPA | 734 |
| H18 | Engineered v10 | DKTHTCPPCPATCPPCPATCPPCPA | 735 |
| H19 | Engineered v11 | DKTHTCPPCPAGKPTLYNSLVMSDT AGTCY | 736 |
| H20 | Engineered v12 | DKTHTCPPCPAGKPTHVNVSVVMAE VDGTCY | 737 |

TABLE 7-continued

Hinge Sequences

| Hinge Name | Hinge Description | Hinge Sequence | SEQ ID NO: |
|---|---|---|---|
| H21 | Engineered v13 | DKTHTCCVECPPCPA | 738 |
| H22 | Engineered v14 | DKTHTCPRCPEPKSCDTPPPCPRCPA | 739 |
| H23 | Engineered v15 | DKTHTCPSCPA | 740 |

In one embodiment, the heavy chain Fc region possesses an intact hinge region at its N-terminus.

In one embodiment, the heavy chain Fc region and hinge region are derived from IgG4 and the hinge region comprises the modified sequence CPPC (SEQ ID NO: 726). The core hinge region of human IgG4 contains the sequence CPSC (SEQ ID NO: 727) compared to IgG1 which contains the sequence CPPC (SEQ ID NO: 726). The serine residue present in the IgG4 sequence leads to increased flexibility in this region, and therefore a proportion of molecules form disulfide bonds within the same protein chain (an intrachain disulfide) rather than bridging to the other heavy chain in the IgG molecule to form the interchain disulfide. (Angel et al., 1993, Mol Immunol 30(1):105-108). Changing the serine residue to a proline to give the same core sequence as IgG1 allows complete formation of inter-chain disulfides in the IgG4 hinge region, thus reducing heterogeneity in the purified product. This altered isotype is termed IgG4P.

7.6.3. ABM Linkers

In certain aspects, the present disclosure provides CD2 binding molecules where two or more components of an ABM (e.g., a VH and a VL of an scFv), two or more ABMs, or an ABM and a non-ABM domain (e.g., a dimerization domain such as an Fc region) are connected to one another by a peptide linker. Such linkers are referred to herein an "ABM linkers", as opposed to the ADC linkers used to attach drugs to CD2 binding molecules as described, for example, in Section 7.13.2.

A peptide linker can range from 2 amino acids to 60 or more amino acids, and in certain aspects a peptide linker ranges from 3 amino acids to 50 amino acids, from 4 to 30 amino acids, from 5 to 25 amino acids, from 10 to 25 amino acids or from 12 to 20 amino acids. In particular embodiments, a peptide linker is 2 amino acids, 3 amino acids, 4 amino acid, 5 amino acids, 6 amino acids, 7 amino acids, 8 amino acids, 9 amino acids, 10 amino acids, 11 amino acids, 12 amino acids, 13 amino acids, 14 amino acid, 15 amino acids, 16 amino acids, 17 amino acids, 18 amino acids, 19 amino acids, 20 amino acids, 21 amino acids, 22 amino acids, 23 amino acids, 24 amino acid, 25 amino acids, 26 amino acids, 27 amino acids, 28 amino acids, 29 amino acids, 30 amino acids, 31 amino acids, 32 amino acids, 33 amino acids, 34 amino acid, 35 amino acids, 36 amino acids, 37 amino acids, 38 amino acids, 39 amino acids, 40 amino acids, 41 amino acids, 42 amino acids, 43 amino acids, 44 amino acid, 45 amino acids, 46 amino acids, 47 amino acids, 48 amino acids, 49 amino acids, or 50 amino acids in length.

Charged and/or flexible linkers can be used.

Examples of flexible ABM linkers that can be used in the CD2 binding molecules include those disclosed by Chen et al., 2013, Adv Drug Deliv Rev. 65(10):1357-1369 and Klein et al., 2014, Protein Engineering, Design & Selection 27(10):325-330. A particularly useful flexible linker is (GGGGS)n (also referred to as (G4S)n) (SEQ ID NO: 741). In some embodiments, n is any number between 1 and 10, i.e., 1, 2, 3, 4, 5, 6, 7, 8, 9, and 10, or any range bounded by any two of the foregoing numbers, e.g., 1 to 5, 2 to 5, 3 to 6, 2 to 4, 1 to 4, and so on and so forth.

Other examples of suitable ABM linkers for use in the CD2 binding molecules of the present disclosure are shown in Table 8 below:

TABLE 8

ABM Linker Sequences

| Linker Name | Linker Sequence | SEQ ID NO: |
|---|---|---|
| L1 | ADAAP | 742 |
| L2 | ADAAPTVSIFP | 743 |
| L3 | ADAAPTVSIFPP | 744 |
| L4 | AKTTAP | 745 |
| L5 | AKTTAPSVYPLAP | 746 |
| L6 | AKTTPKLEEGEFSEARV | 747 |
| L7 | AKTTPKLGG | 748 |
| L8 | AKTTPP | 749 |
| L9 | AKTTPPSVTPLAP | 750 |
| L10 | ASTKGP | 751 |
| L11 | ASTKGPSVFPLAP | 752 |
| L12 | ASTKGPSVFPLAPASTKGPSVFPLAP | 753 |
| L13 | EGKSSGSGSESKST | 754 |
| L14 | GEGESGEGESGEGES | 755 |
| L15 | GEGESGEGESGEGESGEGES | 756 |
| L16 | GEGGSGEGGSGEGGS | 757 |
| L17 | GENKVEYAPALMALS | 758 |
| L18 | GGEGSGGEGSGGEGS | 759 |
| L19 | GGGESGGEGSGEGGS | 760 |
| L20 | GGGESGGGESGGGES | 761 |
| L21 | (GGGGS)$_n$ (also referred to as (G4S)$_n$), Where n can be 1-10. | 762 |
| L22 | GGGGSGGGGS | 763 |
| L23 | GGGGSGGGGSGGGGS | 717 |
| L24 | GGGGSGGGGSGGGGSGGGGS | 764 |
| L25 | GGGKSGGGKSGGGKS | 765 |
| L26 | GGGKSGGKGSGKGGS | 766 |
| L27 | GGKGSGGKGSGGKGS | 767 |
| L28 | GGSGG | 768 |
| L29 | GGSGGGGSG | 769 |
| L30 | GGSGGGGSGGGGS | 770 |
| L31 | GHEAAAVMQVQYPAS | 771 |
| L32 | GKGGSGKGGSGKGGS | 772 |

TABLE 8-continued

ABM Linker Sequences

| Linker Name | Linker Sequence | SEQ ID NO: |
|---|---|---|
| L33 | GKGKSGKGKSGKGKS | 773 |
| L34 | GKGKSGKGKSGKGKSGKGKS | 774 |
| L35 | GKPGSGKPGSGKPGS | 775 |
| L36 | GKPGSGKPGSGKPGSGKPGS | 776 |
| L37 | GPAKELTPLKEAKVS | 777 |
| L38 | GSAGSAAGSGEF | 778 |
| L39 | IRPRAIGGSKPRVA | 779 |
| L40 | KESGSVSSEQLAQFRSLD | 780 |
| L41 | KTTPKLEEGEFSEAR | 781 |
| L42 | QPKAAP | 782 |
| L43 | QPKAAPSVTLFPP | 783 |
| L44 | RADAAAA(G4S)$_4$ | 784 |
| L45 | RADAAAAGGPGS | 785 |
| L46 | RADAAP | 786 |
| L47 | RADAAPTVS | 787 |
| L48 | SAKTTP | 788 |
| L49 | SAKTTPKLEEGEFSEARV | 789 |
| L50 | SAKTTPKLGG | 790 |
| L51 | STAGDTHLGGEDFD | 791 |
| L52 | TVAAP | 792 |
| L53 | TVAAPSVFIFPP | 793 |
| L54 | TVAAPSVFIFPPTVAAPSVFIFPP | 794 |
| L55 | GSTSGSGKPGSGEGSTKG | 795 |
| L56 | PRGASKSGSASQTGSAPGS | 796 |
| L57 | GTAAAGAGAAGGAAAGAAG | 797 |
| L58 | GTSGSSGSGSGGSGSGGGG | 798 |

In various aspects, the disclosure provides a CD2 binding molecule which comprises one or more ABM linkers. Each of the ABM linkers can be range from 2 amino acids to 60 amino acids in length, e.g., 4 to 30 amino acids, from 5 to 25 amino acids, from 10 to 25 amino acids or from 12 to 20 amino acids in length, optionally selected from Table 8 above. In particular embodiments, the CD2 binding molecule comprises two, three, four, five or six ABM linkers. The ABM linkers can be on one, two, three, four or even more polypeptide chains of the CD2 binding molecule.

7.7. Bispecific Binding Molecule Configurations

Exemplary BBM configurations are shown in FIG. 1. FIG. 1A shows the components of the BBM configurations shown in FIGS. 1B-1AH. The scFv, Fab, scFab, non-immunoglobulin based ABM, and Fc domains each can have the characteristics described for these components in Sections 7.5 and 7.6. The components of the BBM configurations shown in FIG. 1 can be associated with each other by any of the means described in Sections 7.5 and 7.6 (e.g., by direct bonds, ABM linkers, disulfide bonds, Fc domains with modified with knob in hole interactions, etc.). The orientations and associations of the various components shown in FIG. 1 are merely exemplary; as will be appreciated by a skilled artisan, other orientations and associations can be suitable (e.g., as described in Sections 7.5 and 7.6).

BBMs are not limited to the configurations shown in FIG. 1. Other configurations that can be used are known to those skilled in the art. See, e.g., WO 2014/145806; WO 2017/124002; Liu et al., 2017, Front Immunol. 8:38; Brinkmann & Kontermann, 2017, mAbs 9:2, 182-212; US 2016/0355600; Klein et al., 2016, MAbs 8(6):1010-20; and US 2017/0145116.

7.7.1. Exemplary Bivalent BBMs

The BBMs can be bivalent, i.e., they have two antigen-binding domains, one of which binds CD2 (ABM1) and one of which binds a second target antigen (ABM2), e.g., a component of a TCR complex or a TAA. In the BBMs of the disclosure, ABM1 is a variant CD58 domain as described herein.

Exemplary bivalent BBM configurations are shown in FIGS. 1B-1F. In the BBMs of the disclosure, a variant CD58 domain can substitute for a Fab and/or scFv in any of the configurations illustrated.

As depicted in FIGS. 1B-1D, a BBM can comprise two half antibodies, one comprising one ABM and the other comprising one ABM, the two halves paired through an Fc domain.

In the embodiment of FIG. 1B, the first (or left) half antibody comprises a Fab and an Fc region, and the second (or right) half antibody comprises a Fab and an Fc region. The first and second half antibodies are associated through the Fc regions forming an Fc domain.

In the embodiment of FIG. 1C, the first (or left) half antibody comprises a Fab and an Fc region, and the second (or right) half antibody comprises a scFv and an Fc region. The first and second half antibodies are associated through the Fc regions forming an Fc domain.

In the embodiment of FIG. 1D, the first (or left) half antibody comprises an scFv and an Fc region, and the second (or right) half antibody comprises an scFv and an Fc region. The first and second half antibodies are associated through the Fc regions forming an Fc domain.

As depicted in FIGS. 1E-1F, a bivalent BBM can comprise two ABMs attached to one Fc region of an Fc domain.

In the embodiment of FIG. 1E, the BBM comprises a Fab, a scFv and an Fc domain, where the scFv is located between the Fab and the Fc domain.

In the embodiment of FIG. 1F, (the "one-arm scFv-mAb" configuration) BBM comprises a Fab, a scFv and an Fc domain, where the Fab is located between the scFv and the Fc domain.

In the configuration shown in FIGS. 1B-1F, each of X and Y represent either ABM1 or ABM2, provided that the BBM comprises one ABM1 and one ABM2. Accordingly, the present disclosure provides a bivalent BBM as shown in any one of FIGS. 1B through 1F, where X is an ABM1 and Y is an ABM2 (this configuration of ABMs designated as "B1" for convenience). The present disclosure also provides a bivalent BBM as shown in any one of FIGS. 1B through 1F, where X is an ABM2 and Y is an ABM1 (this configuration of ABMs designated as "B2" for convenience).

7.7.2. Exemplary Trivalent BBMs

The BBMs can be trivalent, i.e., they have three antigen-binding domains, one or two of which binds CD2 (ABM1) and one or two of which binds a second target antigen (ABM2), e.g., a component of a TCR complex or a TAA. In the BBMs of the disclosure, ABM1 is a variant CD58 domain as described herein.

Exemplary trivalent BBM configurations are shown in FIGS. 1G-1Z. In the BBMs of the disclosure, a variant CD58 domain can substitute for a Fab and/or scFv in any of the configurations illustrated.

As depicted in FIGS. 1G-1N, 1Q-1W, 1Y-1Z a BBM can comprise two half antibodies, one comprising two ABMs and the other comprising one ABM, the two halves paired through an Fc domain.

In the embodiment of FIG. 1G, the first (or left) half antibody comprises Fab and an Fc region, and the second (or right) half antibody comprises a scFv, a Fab, and an Fc region. The first and second half antibodies are associated through the Fc regions forming an Fc domain.

In the embodiment of FIG. 1H, the first (or left) half antibody comprises a Fab and an Fc region, and the second (or right) half antibody comprises a Fab, an scFv, and an Fc region. The first and second half antibodies are associated through the Fc regions forming an Fc domain.

In the embodiment of FIG. 1I, the first (or left) half antibody comprises an scFv and an Fc region, and the second (or right) half antibody comprises two Fabs and an Fc region. The first and second half antibodies are associated through the Fc regions forming an Fc domain.

In the embodiment of FIG. 1J, the first (or left) half antibody comprises two Fav and an Fc region, and the second (or right) half antibody comprises a Fab and an Fc region. The first and second half antibodies are associated through the Fc regions forming an Fc domain.

In the embodiment of FIG. 1K, the first (or left) half antibody comprises an scFv and an Fc region, and the second (or right) half antibody comprises two scFvs and an Fc region. The first and second half antibodies are associated through the Fc regions forming an Fc domain.

In the embodiment of FIG. 1L, the first (or left) half antibody comprises an scFv and an Fc region, and the second (or right) half antibody comprises an scFv, a Fab, and an Fc region.

The first and second half antibodies are associated through the Fc regions forming an Fc domain.

In the embodiment of FIG. 1M, the first (or left) half antibody comprises a scFv and an Fc region, and the second (or right) half antibody comprises a Fab, a scFv and an Fc region. The first and second half antibodies are associated through the Fc regions forming an Fc domain.

In the embodiment of FIG. 1N, the first (or left) half antibody comprises a diabody-type binding domain and an Fc region, and the second (or right) half antibody comprises a Fab and an Fc region. The first and second half antibodies are associated through the Fc regions forming an Fc domain.

In the embodiment of FIG. 1Q, the first (or left) half antibody comprises a Fab and an Fc region, and the second (or right) half antibody comprises a Fab, an Fc region, and an scFv. The first and second half antibodies are associated through the Fc regions forming an Fc domain.

In the embodiment of FIG. 1R, the first (or left) half antibody comprises a scFv and an Fc region, and the second (or right) half antibody comprises a Fab, an Fc region, and an scFv. The first and second half antibodies are associated through the Fc regions forming an Fc domain.

In the embodiment of FIG. 1S, the first (or left) half antibody comprises an scFv and an Fc region, and the second (or right) half antibody comprises an scFv, an Fc region, and a second scFv. The first and second half antibodies are associated through the Fc regions forming an Fc domain.

In the embodiment of FIG. 1T, the first (or left) half antibody comprises an scFv, an Fc region, and a Fab, and the second (or right) half antibody comprises a Fab and an Fc region. The first and second half antibodies are associated through the Fc regions forming an Fc domain.

In the embodiment of FIG. 1U, the first (or left) half antibody comprises two Fab and an Fc region, and the second (or right) half antibody comprises a non-immunoglobulin based ABM and an Fc region. The first and second half antibodies are associated through the Fc regions forming an Fc domain.

In the embodiment of FIG. 1V, the first (or left) half antibody comprises a Fab, an scFv, and an Fc region, and the second (or right) half antibody comprises a non-immunoglobulin based ABM and an Fc region. The first and second half antibodies are associated through the Fc regions forming an Fc domain.

In the embodiment of FIG. 1W, the first (or left) half antibody comprises a Fab and an Fc region, and the second (or right) half antibody comprises a scFv, a non-immunoglobulin based ABM, and an Fc region. The first and second half antibodies are associated through the Fc regions forming an Fc domain.

In the embodiment of FIG. 1Y, the first (or left) half antibody comprises an scFv and an Fc region, and the second (or right) half antibody comprises a Fab, an scFv and an Fc region. The first and second half antibodies are associated through the Fc regions forming an Fc domain.

In the embodiment of FIG. 1Z, the first (or left) half antibody comprises a Fab, an Fc region, and a scFab, and the second (or right) half antibody comprises a Fab and an Fc region. The first and second half antibodies are associated through the Fc regions forming an Fc domain.

Alternatively, as depicted in FIGS. 1O and 1P, trivalent a BBM can comprise two half antibodies, each comprising one complete ABM (a Fab in FIGS. 1O and 1P) and a portion of another ABM (one a VH, the other a VL). The two half antibodies are paired through an Fc domain, whereupon the VH and the VL associate to form a complete antigen-binding Fv domain.

The BBM can be a single chain, as shown in FIG. 1X. The BBM of FIG. 1X comprises three scFv domains connected through linkers.

In the configuration shown in FIGS. 1G-1Z, each of X, Y and A represent either an ABM1 or ABM2, provided that the BBM comprises at least ABM1 and at least one ABM2. Thus, the trivalent MBMs will include one or two ABM1s and one or two ABM2s. In some embodiments, a trivalent BBM comprises two ABM1s and one ABM2. In other embodiments, a trivalent BBM of the disclosure comprises one ABM1 and two ABM2s.

Accordingly, in the present disclosure provides a trivalent BBM as shown in any one of FIGS. 1G through 1Z, where X is an ABM1, Y is an ABM1 and A is an ABM2 (this configuration of ABMs designated as "T1" for convenience).

The disclosure further provides a trivalent BBM as shown in any one of FIGS. 1G through 1Z, where X is an ABM1, Y is an ABM2 and A is an ABM1 (this configuration of ABMs designated as "T2" for convenience).

The disclosure further provides a trivalent BBM as shown in any one of FIGS. 1G through 1Z, where X is an ABM2, Y is an ABM1 and A is an ABM1 (this configuration of ABMs designated as "T3" for convenience).

The disclosure further provides a trivalent BBM as shown in any one of FIGS. 1G through 1Z, where X is an ABM1, Y is an ABM2 and A is an ABM2 (this configuration of ABMs designated as "T4" for convenience).

The disclosure further provides a trivalent BBM as shown in any one of FIGS. 1G through 1Z, where X is an ABM2, Y is an ABM1 and A is an ABM2 (this configuration of ABMs designated as "T5" for convenience).

The disclosure further provides a trivalent BBM as shown in any one of FIGS. 1G through 1Z, where X is an ABM2, Y is an ABM2 and A is an ABM1 (this configuration of ABMs designated as "T6" for convenience).

7.7.3. Exemplary Tetravalent BBMs

The BBMs can be tetravalent, i.e., they have four antigen-binding domains, one, two, or three of which binds CD2 (ABM1) and one, two, or three of which binds a second target antigen (ABM2), e.g., a component of a TCR complex or a TAA. In the BBMs of the disclosure, ABM1 is a variant CD58 domain as described herein.

Exemplary tetravalent BBM configurations are shown in FIGS. 1AA-1AH. In the BBMs of the disclosure, a variant CD58 domain can substitute for a Fab and/or scFv in any of the configurations illustrated.

As depicted in FIGS. 1AA-1AH, a tetravalent BBM can comprise two half antibodies, each comprising two complete ABMs, the two halves paired through an Fc domain.

In the embodiment of FIG. 1AA, the first (or left) half antibody comprises a Fab, an Fc region, and an scFv, and the second (or right) half antibody comprises a Fab, an Fc region, and an scFv. The first and second half antibodies are associated through the Fc regions forming an Fc domain.

In the embodiment of FIG. 1AB, the first (or left) half antibody comprises a Fab, an scFv, and an Fc region, and the second (or right) half antibody comprises a Fab, an scFv, and an Fc region. The first and second half antibodies are associated through the Fc regions forming an Fc domain.

In the embodiment of FIG. 1AC, the first (or left) half antibody comprises an scFv, a Fab, and an Fc region, and the second (or right) half antibody comprises an scFv, a Fab, and an Fc region. The first and second half antibodies are associated through the Fc regions forming an Fc domain.

In the embodiment of FIG. 1AD, the first (or left) half antibody comprises a Fab, an Fc region, and a second Fab, and the second (or right) half antibody comprises a Fab, an Fc region, and a second Fab. The first and second half antibodies are associated through the Fc regions forming an Fc domain.

In the embodiment of FIG. 1AE, the first (or left) half antibody comprises an scFv, a second scFv, and an Fc region, and the second (or right) half antibody comprises an scFv, a second scFv, and an Fc region. The first and second half antibodies are associated through the Fc regions forming an Fc domain.

In the embodiment of FIG. 1AF, the first (or left) half antibody comprises a Fab, an scFv, and an Fc region, and the second (or right) half antibody comprises a Fab, an scFv, and an Fc region. The first and second half antibodies are associated through the Fc regions forming an Fc domain.

In the embodiment of FIG. 1AG, the first (or left) half antibody comprises a Fab, an Fc region, and an scFv, and the second (or right) half antibody comprises a scFv, an Fc region, and a Fab. The first and second half antibodies are associated through the Fc regions forming an Fc domain.

In the embodiment of FIG. 1AH, the first (or left) half antibody comprises a scFv, an Fc region, and an Fab, and the second (or right) half antibody comprises a scFv, an Fc region, and a Fab. The first and second half antibodies are associated through the Fc regions forming an Fc domain.

In the configuration shown in FIGS. 1AA-1AH, each of X, Y, A, and B represent ABM1 or ABM2, although not necessarily in that order, and provided that the BBM comprises at least one ABM1 and at least one ABM2. Thus, the tetravalent ABMs will include one, two, or three ABM1s and one, two, or ABM2s. In some embodiments, a tetravalent BBM comprises three ABM1s and one ABM2. In other embodiments, a tetravalent BBM comprises two ABM1s two ABM2s. In yet other embodiments, a tetravalent BBM comprises one ABM1 and three ABM2s.

Accordingly, in the present disclosure provides a tetravalent BBM as shown in any one of FIGS. 1AA-1AH, where X is an ABM1 and each of Y, A, and B are ABM2s (this configuration of ABMs designated as "Tv 1" for convenience).

The disclosure further provides a tetravalent BBM as shown in any one of FIGS. 1AA-1AH, where Y is an ABM1 and each of X, A, and B are ABM2s (this configuration of ABMs designated as "Tv 2" for convenience).

The disclosure further provides a tetravalent BBM as shown in any one of FIGS. 1AA-1AH, where A is an ABM1 and each of X, Y, and B are ABM2s (this configuration of ABMs designated as "Tv 3" for convenience).

The disclosure further provides a tetravalent BBM as shown in any one of FIGS. 1AA-1AH, where B is an ABM1 and each of X, Y, and A are ABM2s (this configuration of ABMs designated as "Tv 4" for convenience).

The disclosure further provides a tetravalent BBM as shown in any one of FIGS. 1AA-1AH, where X and Y are both ABM1s and both of A and B are ABM2s (this configuration of ABMs designated as "Tv 5" for convenience).

The disclosure further provides a tetravalent BBM as shown in any one of FIGS. 1AA-1AH, where X and A are both ABM1s and both of Y and B are ABM2s (this configuration of ABMs designated as "Tv 6" for convenience).

The disclosure further provides a tetravalent BBM as shown in any one of FIGS. 1AA-1AH, where X and B are both ABM1s and both of Y and A are ABM2s (this configuration of ABMs designated as "Tv 7" for convenience).

The disclosure further provides a tetravalent BBM as shown in any one of FIGS. 1AA-1AH, where Y and A are both ABM1s and both of X and B are ABM2s (this configuration of ABMs designated as "Tv 8" for convenience).

The disclosure further provides a tetravalent BBM as shown in any one of FIGS. 1AA-1AH, where Y and B are both ABM1s and both of X and A are ABM2s (this configuration of ABMs designated as "Tv 9" for convenience).

The disclosure further provides a tetravalent BBM as shown in any one of FIGS. 1AA-1AH, where A and B are both ABM1s and both of X and Y are ABM2s (this configuration of ABMs designated as "Tv 10" for convenience).

The disclosure further provides a tetravalent BBM as shown in any one of FIGS. 1AA-1AH, where each of X, Y, and A is an ABM1 and B is an ABM2 (this configuration of ABMs designated as "Tv 11" for convenience).

The disclosure further provides a tetravalent BBM as shown in any one of FIGS. 1AA-1AH, where each of X, Y, and B is an ABM1 and A is an ABM2 (this configuration of ABMs designated as "Tv 12" for convenience).

The disclosure further provides a tetravalent BBM as shown in any one of FIGS. 1AA-1AH, where each of X, A, and B is an ABM1 and Y is an ABM2 (this configuration of ABMs designated as "Tv 13" for convenience).

The disclosure further provides a tetravalent BBM as shown in any one of FIGS. 1AA-1AH, where each of Y, A, and B is an ABM1 and X is an ABM2 (this configuration of ABMs designated as "Tv 14" for convenience).

7.8. Trispecific Binding Molecule Configurations

Exemplary TBM configurations are shown in FIG. 2. FIG. 2A shows the components of the TBM configurations shown in FIGS. 2B-1V. The scFv, Fab, non-immunoglobulin based ABM, and Fc each can have the characteristics described for these components in Sections 7.5 and 7.6. The components of the TBM configurations shown in FIG. 2 can be associated with each other by any of the means described in Sections 7.5 and 7.6 (e.g., by direct bonds, ABM linkers, disulfide bonds, Fc domains with modified with knob in hole interactions, etc.). The orientations and associations of the various components shown in FIG. 2 are merely exemplary; as will be appreciated by a skilled artisan, other orientations and associations can be suitable (e.g., as described in Sections 7.5 and 7.6).

TBMs are not limited to the configurations shown in FIG. 2. Other configurations that can be used are known to those skilled in the art. See, e.g., WO 2014/145806; WO 2017/124002; Liu et al., 2017, Front Immunol. 8:38; Brinkmann & Kontermann, 2017, mAbs 9:2, 182-212; US 2016/0355600; Klein et al., 2016, MAbs 8(6):1010-20; and US 2017/0145116.

7.8.1. Exemplary Trivalent TBMs

The TBMs of the disclosure can be trivalent, e.g., they can have three antigen-binding modules, one of which binds CD2, one of which binds a component of a TCR complex, and one of which binds a TAA; or they can have three antigen-binding modules, one of which binds CD2, one of which binds a TAA, and one of which binds a second TAA. In the TBMs of the disclosure, the antigen-binding module that binds to CD2 is a variant CD58 domain as described herein.

Exemplary trivalent TBM configurations are shown in FIGS. 2B through 2P. In the TBMs of the disclosure, a variant CD58 domain can substitute for a Fab and/or scFv in any of the configurations illustrated.

As depicted in FIGS. 2B-2K and 2N-2P, a TBM can comprise two half antibodies, one comprising two ABMs and the other comprising one ABM, the two halves paired through an Fc domain.

In the embodiment of FIG. 2B, the first (or left) half antibody comprises an scFv and an Fc region, and the second (or right) half antibody comprises a Fab, an scFv and an Fc region. The first and second half antibodies are associated through the Fc regions forming an Fc domain.

In the embodiment of FIG. 2C, the first (or left) half antibody comprises two Fab and an Fc region, and the second (or right) half antibody comprises a Fab and an Fc region. The first and second half antibodies are associated through the Fc regions forming an Fc domain.

In the embodiment of FIG. 2D, the first (or left) half antibody comprises a Fab, an scFv and an Fc region, and the second (or right) half antibody comprises a Fab and an Fc region. The first and second half antibodies are associated through the Fc regions forming an Fc domain.

In the embodiment of FIG. 2E, the first (or left) half antibody comprises an scFv and an Fc region, and the second (or right) half antibody comprises two Fab and an Fc region. The first and second half antibodies are associated through the Fc regions forming an Fc domain.

In the embodiment of FIG. 2F, the first (or left) half antibody comprises an scFv, an Fc region, and a Fab, and the second (or right) half antibody comprises a Fab and an Fc region. The first and second half antibodies are associated through the Fc regions forming an Fc domain.

In the embodiment of FIG. 2G, the first (or left) half antibody comprises an scFv and an Fc region, and the second (or right) half antibody comprises a Fab an Fc region, and an scFV. The first and second half antibodies are associated through the Fc regions forming an Fc domain.

In the embodiment of FIG. 2H, the first (or left) half antibody comprises two Fab and an Fc region, and the second (or right) half antibody comprises a non-immunoglobulin based ABM and an Fc region. The first and second half antibodies are associated through the Fc regions forming an Fc domain.

In the embodiment of FIG. 2I, the first (or left) half antibody comprises a Fab, an scFv, and an Fc region, and the second (or right) half antibody comprises a non-immunoglobulin based ABM and an Fc region. The first and second half antibodies are associated through the Fc regions forming an Fc domain.

In the embodiment of FIG. 2J, the first (or left) half antibody comprises a Fab and an Fc region, and the second (or right) half antibody comprises an scFv, a non-immunoglobulin based ABM and an Fc region. The first and second half antibodies are associated through the Fc regions forming an Fc domain.

In the embodiment of FIG. 2K, the first (or left) half antibody comprises an scFv and an Fc region, and the second (or right) half antibody comprises an scFv, an Fc region, and a second scFv. The first and second half antibodies are associated through the Fc regions forming an Fc domain.

In the embodiment of FIG. 2N, the first (or left) half antibody comprises a Fab, an Fc region, and an scFv, and the second (or right) half antibody comprises a Fab, and an Fc region. The first and second half antibodies are associated through the Fc regions forming an Fc domain.

In the embodiment of FIG. 2O, the first (or left) half antibody comprises a Fab, an Fc region, and a scFab, and the second (or right) half antibody comprises a Fab and an Fc region. The first and second half antibodies are associated through the Fc regions forming an Fc domain.

In the embodiment of FIG. 2P, the first (or left) half antibody comprises a Fab, a non-immunoglobulin based ABM, and an Fc region, and the second (or right) half antibody comprises a scFv and an Fc region. The first and second half antibodies are associated through the Fc regions forming an Fc domain.

Alternatively, as depicted in FIG. 2L, trivalent a TBM can comprise two half antibodies, each comprising one complete ABM and a portion of another ABM (one a VH, the other a VL). The two half antibodies are paired through an Fc domain, whereupon the VH and the VL associate to form a complete antigen-binding Fv domain.

The TBM can be a single chain, as shown in FIG. 2M. The TBM of FIG. 2M comprises three scFv domains connected through linkers.

In each of the configurations shown in FIGS. 2B-2P, each of the domains designated X, Y, and Z represents an ABM1, ABM2, or ABM3, although not necessarily in that order. In other words, X can be ABM1, ABM2, or ABM3, Y can be ABM1, ABM2, or ABM3, and Z can be ABM1, ABM2, or ABM3, provided that the TBM comprises one ABM1, one ABM2, and one ABM3.

Accordingly, in the present disclosure provides a trivalent TBM as shown in any one of FIGS. 2B through 2P, where X is an ABM1, Y is an ABM3 and Z is an ABM2 (this configuration of ABMs designated as "T1" for convenience).

The present disclosure also provides a trivalent TBM as shown in any one of FIGS. 2B through 2P, where X is an ABM1, Y is an ABM2, and Z is an ABM3 (this configuration of ABMs designated as "T2" for convenience).

The present disclosure further provides a trivalent TBM as shown in any one of FIGS. 2B through 2P, where X is an ABM3, Y is an ABM1, and Z is an ABM2 (this configuration of ABMs designated as "T3" for convenience).

The present disclosure yet further provides a trivalent TBM as shown in any one of FIGS. 2B through 2P, where X is an ABM3, Y is an ABM2, and Z is an ABM1 (this configuration of ABMs designated as "T4" for convenience).

The present disclosure yet further provides a trivalent TBM as shown in any one of FIGS. 2B through 2P, where X is an ABM2, Y is an ABM1, and Z is an ABM3 (this configuration of ABMs designated as "T5" for convenience).

The present disclosure yet further provides a trivalent TBM as shown in any one of FIGS. 2B through 2P, where X is an ABM2, Y is an ABM3, and Z is an ABM1 (this configuration of ABMs designated as "T6" for convenience).

7.8.2. Exemplary Tetravalent TBMs

The TBMs of the disclosure can be tetravalent, e.g., they can have four antigen-binding modules, one or two of which binds CD2, one or two of which binds a component of a TCR complex, and one or two of which binds a TAA; or they can have four antigen-binding modules, one or two of which binds CD2, one or two of which binds a TAA, and one or two of which binds a second TAA. In the TBMs of the disclosure, the antigen-binding module that binds to CD2 is a variant CD58 domain as described herein.

Exemplary tetravalent TBM configurations are shown in FIGS. 2Q-2S. In the TBMs of the disclosure, a variant CD58 domain can substitute for a Fab and/or scFv in any of the configurations illustrated.

As depicted in FIGS. 2Q-2S, a tetravalent TBM can comprise two half antibodies, each comprising two complete ABMs, the two halves paired through an Fc domain.

In the embodiment of FIG. 2Q, the first (or left) half antibody comprises a Fab, an Fc region, and a second Fab, and the second (or right) half antibody comprises a Fab, an Fc region, and a second Fab. The first and second half antibodies are associated through the Fc regions forming an Fc domain.

In the embodiment of FIG. 2R, the first (or left) half antibody comprises a Fab, an Fc region, and an scFv, and the second (or right) half antibody comprises a Fab, an Fc region, and an scFv. The first and second half antibodies are associated through the Fc regions forming an Fc domain.

In the embodiment of FIG. 2S, the first (or left) half antibody comprises a Fab, an Fc region, and an scFv, and the second (or right) half antibody comprises an scFv, an Fc region, and a Fab. The first and second half antibodies are associated through the Fc regions forming an Fc domain.

In the configuration shown in FIGS. 2Q-2S, each of X, Y, Z, and A represent an ABM1, an ABM2, or an ABM3, although not necessarily in that order, and provided that the TBM comprises at least one ABM1, at least one ABM2, and at least one ABM3. Thus, the tetravalent ABMs can include, for example, two ABMs against one of CD2, a component of a TCR complex, and a TAA. In some cases, a tetravalent TBM has two ABM1s, 2 ABM2s, or two ABM3s.

Accordingly, the present disclosure provides tetravalent TBMs as shown in any one of FIGS. 2Q-2S, where X, Y, Z, and A are ABM1s, ABM2s, and ABM3s, as shown in Table 9.

TABLE 9

ABM Permutations in Tetravalent TBMs

| Tetravalent Configuration | X | Y | Z | A |
|---|---|---|---|---|
| Tv 1 | ABM1 | ABM1 | ABM3 | ABM2 |
| Tv 2 | ABM1 | ABM1 | ABM2 | ABM3 |
| Tv 3 | ABM1 | ABM3 | ABM1 | ABM2 |
| Tv 4 | ABM1 | ABM2 | ABM1 | ABM3 |
| Tv 5 | ABM1 | ABM3 | ABM2 | ABM1 |
| Tv 6 | ABM1 | ABM2 | ABM3 | ABM1 |
| Tv 7 | ABM3 | ABM1 | ABM1 | ABM2 |
| Tv 8 | ABM2 | ABM1 | ABM1 | ABM3 |
| Tv 9 | ABM3 | ABM1 | ABM2 | ABM1 |
| Tv 10 | ABM2 | ABM1 | ABM3 | ABM1 |
| Tv 11 | ABM3 | ABM2 | ABM1 | ABM1 |
| Tv 12 | ABM2 | ABM3 | ABM1 | ABM1 |
| Tv 13 | ABM1 | ABM3 | ABM2 | ABM2 |
| Tv 14 | ABM1 | ABM2 | ABM3 | ABM2 |
| Tv 15 | ABM1 | ABM2 | ABM2 | ABM3 |
| Tv 16 | ABM3 | ABM1 | ABM2 | ABM2 |
| Tv 17 | ABM2 | ABM1 | ABM3 | ABM2 |
| Tv 18 | ABM2 | ABM1 | ABM2 | ABM3 |
| Tv 19 | ABM3 | ABM2 | ABM1 | ABM2 |
| Tv 20 | ABM2 | ABM3 | ABM1 | ABM2 |
| Tv 21 | ABM2 | ABM2 | ABM1 | ABM3 |
| Tv 22 | ABM3 | ABM2 | ABM2 | ABM1 |
| Tv 23 | ABM2 | ABM3 | ABM2 | ABM1 |
| Tv 24 | ABM2 | ABM2 | ABM3 | ABM1 |

7.8.3. Exemplary Pentavalent TBMs

The TBMs of the disclosure can be pentavalent, e.g., they can have five antigen-binding domains, one, two, or three of which binds CD2, one, two, or three of which binds a component of a TCR complex, and one, two, or three of which binds a TAA; or they can have five antigen-binding domains, one, two, or three of which binds CD2, one, two, or three of which binds a TAA, and one, two, or three of which binds a second TAA. In the TBMs of the disclosure, the antigen-binding module that binds to CD2 is a variant CD58 domain as described herein.

An exemplary pentavalent TBM configuration is shown in FIG. 2T. In the TBMs of the disclosure, a variant CD58 domain can substitute for a Fab and/or scFv in any of the configurations illustrated.

As depicted in FIG. 2T, a pentavalent TBM can comprise two half antibodies, one of which comprises two complete ABMs and the other of which comprises one complete ABM, the two halves paired through an Fc domain.

In the embodiment of FIG. 2T, the first (or left) half antibody comprises a Fab, an scFv, and an Fc region, and the second (or right) half antibody comprises a Fab, an Fc region, and an scFv. The first and second half antibodies are associated through the Fc regions forming an Fc domain.

In the configuration shown in FIG. 2T, each of X, Y, Z, A, and B represent an ABM1, an ABM2, or an ABM3, although not necessarily in that order, and provided that the TBM comprises at least one ABM1, one ABM2, and one ABM3. Thus, the pentavalent TBMs can include, for example, two ABMs against two of CD2, a component of a TCR complex, and a TAA, or three ABMs against one of CD2, a component of a TCR complex, and a TAA. In some cases, a pentavalent TBM has two or three CD2 ABMs. In some embodiments, a pentavalent TBM has three ABM1s, one ABM2 and one ABM3.

Accordingly, the present disclosure provides a pentavalent TBM as shown in FIG. 2T, where X, Y, Z, A, and B are ABM1s, ABM2s, and ABM3s as shown in Table 10.

TABLE 10

ABM Permutations in Pentavalent TBMs

| Pentavalent Configuration | X | Y | Z | A | B |
|---|---|---|---|---|---|
| Pv 1 | ABM1 | ABM1 | ABM1 | ABM3 | ABM2 |
| Pv 2 | ABM1 | ABM1 | ABM1 | ABM2 | ABM3 |
| Pv 3 | ABM1 | ABM1 | ABM3 | ABM1 | ABM2 |
| Pv 4 | ABM1 | ABM1 | ABM2 | ABM1 | ABM3 |
| Pv 5 | ABM1 | ABM1 | ABM3 | ABM2 | ABM1 |
| Pv 6 | ABM1 | ABM1 | ABM2 | ABM3 | ABM1 |
| Pv 7 | ABM1 | ABM3 | ABM1 | ABM1 | ABM2 |
| Pv 8 | ABM1 | ABM2 | ABM1 | ABM1 | ABM3 |
| Pv 9 | ABM1 | ABM3 | ABM1 | ABM2 | ABM1 |
| Pv 10 | ABM1 | ABM2 | ABM1 | ABM3 | ABM1 |
| Pv 11 | ABM1 | ABM3 | ABM2 | ABM1 | ABM1 |
| Pv 12 | ABM1 | ABM2 | ABM3 | ABM1 | ABM1 |
| Pv 13 | ABM3 | ABM1 | ABM1 | ABM1 | ABM2 |
| Pv 14 | ABM2 | ABM1 | ABM1 | ABM1 | ABM3 |
| Pv 15 | ABM3 | ABM1 | ABM1 | ABM2 | ABM1 |
| Pv 16 | ABM2 | ABM1 | ABM1 | ABM3 | ABM1 |
| Pv 17 | ABM3 | ABM1 | ABM2 | ABM1 | ABM1 |
| Pv 18 | ABM2 | ABM1 | ABM3 | ABM1 | ABM1 |
| Pv 19 | ABM3 | ABM2 | ABM1 | ABM1 | ABM1 |
| Pv 20 | ABM2 | ABM3 | ABM1 | ABM1 | ABM1 |
| Pv 21 | ABM1 | ABM1 | ABM3 | ABM3 | ABM2 |
| Pv 22 | ABM1 | ABM1 | ABM3 | ABM2 | ABM3 |
| Pv 23 | ABM1 | ABM1 | ABM2 | ABM3 | ABM3 |
| Pv 24 | ABM1 | ABM3 | ABM1 | ABM3 | ABM2 |
| Pv 25 | ABM1 | ABM3 | ABM1 | ABM2 | ABM3 |
| Pv 26 | ABM1 | ABM2 | ABM1 | ABM3 | ABM3 |
| Pv 27 | ABM1 | ABM3 | ABM3 | ABM1 | ABM2 |
| Pv 28 | ABM1 | ABM3 | ABM2 | ABM1 | ABM3 |
| Pv 29 | ABM1 | ABM2 | ABM3 | ABM1 | ABM3 |
| Pv 30 | ABM1 | ABM3 | ABM3 | ABM2 | ABM1 |
| Pv 31 | ABM1 | ABM3 | ABM2 | ABM3 | ABM1 |
| Pv 32 | ABM1 | ABM2 | ABM3 | ABM3 | ABM1 |
| Pv 33 | ABM3 | ABM1 | ABM1 | ABM3 | ABM2 |
| Pv 34 | ABM3 | ABM1 | ABM1 | ABM2 | ABM3 |
| Pv 35 | ABM2 | ABM1 | ABM1 | ABM3 | ABM3 |
| Pv 36 | ABM3 | ABM1 | ABM3 | ABM1 | ABM2 |
| Pv 37 | ABM3 | ABM1 | ABM2 | ABM1 | ABM3 |
| Pv 38 | ABM2 | ABM1 | ABM3 | ABM1 | ABM3 |
| Pv 39 | ABM3 | ABM1 | ABM3 | ABM2 | ABM1 |
| Pv 40 | ABM3 | ABM1 | ABM2 | ABM3 | ABM1 |
| Pv 41 | ABM2 | ABM1 | ABM3 | ABM3 | ABM1 |
| Pv 42 | ABM3 | ABM3 | ABM1 | ABM1 | ABM2 |
| Pv 43 | ABM3 | ABM2 | ABM1 | ABM1 | ABM3 |
| Pv 44 | ABM2 | ABM3 | ABM1 | ABM1 | ABM3 |
| Pv 45 | ABM3 | ABM3 | ABM1 | ABM2 | ABM1 |
| Pv 46 | ABM3 | ABM2 | ABM1 | ABM3 | ABM1 |
| Pv 47 | ABM2 | ABM3 | ABM1 | ABM3 | ABM1 |
| Pv 48 | ABM3 | ABM3 | ABM2 | ABM1 | ABM1 |
| Pv 49 | ABM3 | ABM2 | ABM3 | ABM1 | ABM1 |
| Pv 50 | ABM2 | ABM3 | ABM3 | ABM1 | ABM1 |
| Pv 51 | ABM1 | ABM1 | ABM1 | ABM2 | ABM2 |
| Pv 52 | ABM1 | ABM1 | ABM2 | ABM3 | ABM2 |
| Pv 53 | ABM1 | ABM1 | ABM2 | ABM2 | ABM3 |
| Pv 54 | ABM1 | ABM3 | ABM1 | ABM2 | ABM2 |
| Pv 55 | ABM1 | ABM2 | ABM1 | ABM3 | ABM2 |
| Pv 56 | ABM1 | ABM2 | ABM1 | ABM2 | ABM3 |
| Pv 57 | ABM1 | ABM3 | ABM2 | ABM1 | ABM2 |
| Pv 58 | ABM1 | ABM2 | ABM3 | ABM1 | ABM2 |
| Pv 59 | ABM1 | ABM2 | ABM2 | ABM1 | ABM3 |
| Pv 60 | ABM1 | ABM3 | ABM2 | ABM2 | ABM1 |
| Pv 61 | ABM1 | ABM2 | ABM3 | ABM2 | ABM1 |
| Pv 62 | ABM1 | ABM2 | ABM2 | ABM3 | ABM1 |
| Pv 63 | ABM3 | ABM1 | ABM1 | ABM2 | ABM2 |
| Pv 64 | ABM2 | ABM1 | ABM1 | ABM3 | ABM2 |

TABLE 10-continued

ABM Permutations in Pentavalent TBMs

| Pentavalent Configuration | X | Y | Z | A | B |
|---|---|---|---|---|---|
| Pv 65 | ABM2 | ABM1 | ABM1 | ABM2 | ABM3 |
| Pv 66 | ABM3 | ABM1 | ABM2 | ABM1 | ABM2 |
| Pv 67 | ABM2 | ABM1 | ABM3 | ABM1 | ABM2 |
| Pv 68 | ABM2 | ABM1 | ABM2 | ABM1 | ABM3 |
| Pv 69 | ABM3 | ABM1 | ABM2 | ABM2 | ABM1 |
| Pv 70 | ABM2 | ABM1 | ABM3 | ABM2 | ABM1 |
| Pv 71 | ABM2 | ABM1 | ABM2 | ABM3 | ABM1 |
| Pv 72 | ABM3 | ABM2 | ABM1 | ABM1 | ABM2 |
| Pv 73 | ABM2 | ABM3 | ABM1 | ABM1 | ABM2 |
| Pv 74 | ABM2 | ABM2 | ABM1 | ABM1 | ABM3 |
| Pv 75 | ABM3 | ABM2 | ABM1 | ABM2 | ABM1 |
| Pv 76 | ABM2 | ABM3 | ABM1 | ABM2 | ABM1 |
| Pv 77 | ABM2 | ABM2 | ABM1 | ABM3 | ABM1 |
| Pv 78 | ABM3 | ABM2 | ABM2 | ABM1 | ABM1 |
| Pv 79 | ABM2 | ABM3 | ABM2 | ABM1 | ABM1 |
| Pv 80 | ABM2 | ABM2 | ABM3 | ABM1 | ABM1 |
| Pv 81 | ABM1 | ABM3 | ABM2 | ABM2 | ABM2 |
| Pv 82 | ABM1 | ABM2 | ABM3 | ABM2 | ABM2 |
| Pv 83 | ABM1 | ABM2 | ABM2 | ABM3 | ABM2 |
| Pv 84 | ABM1 | ABM2 | ABM2 | ABM2 | ABM3 |
| Pv 85 | ABM3 | ABM1 | ABM2 | ABM2 | ABM2 |
| Pv 86 | ABM2 | ABM1 | ABM3 | ABM2 | ABM2 |
| Pv 87 | ABM2 | ABM1 | ABM2 | ABM3 | ABM2 |
| Pv 88 | ABM2 | ABM1 | ABM2 | ABM2 | ABM3 |
| Pv 89 | ABM3 | ABM2 | ABM1 | ABM2 | ABM2 |
| Pv 90 | ABM2 | ABM3 | ABM1 | ABM2 | ABM2 |
| Pv 91 | ABM2 | ABM2 | ABM1 | ABM3 | ABM2 |
| Pv 92 | ABM2 | ABM2 | ABM1 | ABM2 | ABM3 |
| Pv 93 | ABM3 | ABM2 | ABM2 | ABM1 | ABM2 |
| Pv 94 | ABM2 | ABM3 | ABM2 | ABM1 | ABM2 |
| Pv 95 | ABM2 | ABM2 | ABM3 | ABM1 | ABM2 |
| Pv 96 | ABM2 | ABM2 | ABM2 | ABM1 | ABM3 |
| Pv 97 | ABM3 | ABM2 | ABM2 | ABM2 | ABM1 |
| Pv 98 | ABM2 | ABM3 | ABM2 | ABM2 | ABM1 |
| Pv 99 | ABM2 | ABM2 | ABM3 | ABM2 | ABM1 |
| Pv 100 | ABM2 | ABM2 | ABM2 | ABM3 | ABM1 |

7.8.4. Exemplary Hexavalent TBMs

The TBMs of the disclosure can be hexavalent, e.g., they can have six antigen-binding modules, one, two, three, or four of which binds CD2, one, two, three, or four of which binds a component of a TCR complex, and one, two, three, or four of which binds a TAA; or they can have six antigen-binding modules, one, two, three, or four of which binds CD2, one, two, three, or four of which binds a TAA, and one, two, three, or four of which binds a second TAA. In the TBMs of the disclosure, the ABM that binds CD2 is a variant CD58 domain as described herein.

Exemplary hexavalent TBM configurations are shown in FIGS. 2U-2V. In the TBMs of the disclosure, a variant CD58 domain can substitute for a Fab and/or scFv in any of the configurations illustrated.

As depicted in FIGS. 2U-2V, a hexavalent TBM can comprise two half antibodies, one of which comprises two complete ABMs and the other of which comprises one complete ABM, the two halves paired through an Fc domain.

In the embodiment of FIG. 2U, the first (or left) half antibody comprises a Fab, a second Fab, an Fc region, and an scFv, and the second (or right) half antibody comprises a Fab, a second Fab, an Fc region, and an scFv. The first and second half antibodies are associated through the Fc regions forming an Fc domain.

In the embodiment of FIG. 2V, the first (or left) half antibody comprises a first Fv, a second Fv, a third Fv, and an Fc region, and the second (or right) half antibody comprises a first Fv, a second Fv, a third Fv, and an Fc region. The first and second half antibodies are associated through the Fc regions forming an Fc domain.

In the configuration shown in FIGS. 2U-2V, each of X, Y, Z, A, B, and C represent an ABM1, an ABM2, or an ABM3, although not necessarily in that order, and provided that the TBM comprises at least one ABM1, one ABM2, and one ABM3. Thus, the hexavalent TBMs can include, for example, (i) two ABMs against each of CD2, a component of a TCR complex, and a TAA, (ii) three ABMs against one of CD2, a component of a TCR complex, and a TAA, or (iii) four ABMs against one of CD2, a component of a TCR complex, and a TAA. For example, a hexavalent ABM can include three ABMs against CD2, two ABMs against a TAA and one ABM against a component of a TCR complex. As another example, a hexavalent ABM can include three ABMs against CD2, two ABMs against a component of a TCR complex and one ABM against a TAA. In some cases, a hexavalent TBM has two, three, our four CD2 ABMs. In some embodiments, a hexavalent TBM has three CD2 ABMs. In other embodiments, a hexavalent TBM has four CD2 ABMs.

Accordingly, in the present disclosure provides hexavalent TBMs as shown in any one of FIGS. 2U-2V, where X, Y, Z, A, B, and C are ABM1s, ABM2s, and ABM3s, as shown in Table 11.

TABLE 11

ABM Permutations in Hexavalent TBMs

| Hexavalent Configuration | X | Y | Z | A | B | C |
|---|---|---|---|---|---|---|
| Hv 1 | ABM1 | ABM1 | ABM1 | ABM1 | ABM3 | ABM2 |
| Hv 2 | ABM1 | ABM1 | ABM1 | ABM1 | ABM2 | ABM3 |
| Hv 3 | ABM1 | ABM1 | ABM1 | ABM3 | ABM1 | ABM2 |
| Hv 4 | ABM1 | ABM1 | ABM1 | ABM2 | ABM1 | ABM3 |
| Hv 5 | ABM1 | ABM1 | ABM1 | ABM3 | ABM2 | ABM1 |
| Hv 6 | ABM1 | ABM1 | ABM1 | ABM2 | ABM3 | ABM1 |
| Hv 7 | ABM1 | ABM1 | ABM3 | ABM1 | ABM1 | ABM2 |
| Hv 8 | ABM1 | ABM1 | ABM2 | ABM1 | ABM1 | ABM3 |
| Hv 9 | ABM1 | ABM1 | ABM3 | ABM1 | ABM2 | ABM1 |
| Hv 10 | ABM1 | ABM1 | ABM2 | ABM1 | ABM3 | ABM1 |
| Hv 11 | ABM1 | ABM1 | ABM3 | ABM2 | ABM1 | ABM1 |
| Hv 12 | ABM1 | ABM1 | ABM2 | ABM3 | ABM1 | ABM1 |
| Hv 13 | ABM1 | ABM3 | ABM1 | ABM1 | ABM1 | ABM2 |
| Hv 14 | ABM1 | ABM2 | ABM1 | ABM1 | ABM1 | ABM3 |
| Hv 15 | ABM1 | ABM3 | ABM1 | ABM1 | ABM2 | ABM1 |
| Hv 16 | ABM1 | ABM2 | ABM1 | ABM1 | ABM3 | ABM1 |
| Hv 17 | ABM1 | ABM3 | ABM1 | ABM2 | ABM1 | ABM1 |
| Hv 18 | ABM1 | ABM2 | ABM1 | ABM3 | ABM1 | ABM1 |
| Hv 19 | ABM1 | ABM3 | ABM2 | ABM1 | ABM1 | ABM1 |
| Hv 20 | ABM1 | ABM2 | ABM3 | ABM1 | ABM1 | ABM1 |
| Hv 21 | ABM3 | ABM1 | ABM1 | ABM1 | ABM1 | ABM2 |
| Hv 22 | ABM2 | ABM1 | ABM1 | ABM1 | ABM1 | ABM3 |
| Hv 23 | ABM3 | ABM1 | ABM1 | ABM1 | ABM2 | ABM1 |
| Hv 24 | ABM2 | ABM1 | ABM1 | ABM1 | ABM3 | ABM1 |
| Hv 25 | ABM3 | ABM1 | ABM1 | ABM2 | ABM1 | ABM1 |
| Hv 26 | ABM2 | ABM1 | ABM1 | ABM3 | ABM1 | ABM1 |
| Hv 27 | ABM3 | ABM1 | ABM2 | ABM1 | ABM1 | ABM1 |
| Hv 28 | ABM2 | ABM1 | ABM3 | ABM1 | ABM1 | ABM1 |
| Hv 29 | ABM3 | ABM2 | ABM1 | ABM1 | ABM1 | ABM1 |
| Hv 30 | ABM2 | ABM3 | ABM1 | ABM1 | ABM1 | ABM1 |
| Hv 31 | ABM1 | ABM1 | ABM1 | ABM3 | ABM3 | ABM2 |
| Hv 32 | ABM1 | ABM1 | ABM1 | ABM3 | ABM2 | ABM3 |
| Hv 33 | ABM1 | ABM1 | ABM1 | ABM2 | ABM3 | ABM3 |
| Hv 34 | ABM1 | ABM1 | ABM3 | ABM1 | ABM3 | ABM2 |
| Hv 35 | ABM1 | ABM1 | ABM3 | ABM1 | ABM2 | ABM3 |
| Hv 36 | ABM1 | ABM1 | ABM2 | ABM1 | ABM3 | ABM3 |
| Hv 37 | ABM1 | ABM1 | ABM3 | ABM3 | ABM1 | ABM2 |
| Hv 38 | ABM1 | ABM1 | ABM3 | ABM2 | ABM1 | ABM3 |
| Hv 39 | ABM1 | ABM1 | ABM2 | ABM3 | ABM1 | ABM3 |
| Hv 40 | ABM1 | ABM1 | ABM3 | ABM3 | ABM2 | ABM1 |
| Hv 41 | ABM1 | ABM1 | ABM3 | ABM2 | ABM3 | ABM1 |
| Hv 42 | ABM1 | ABM1 | ABM2 | ABM3 | ABM3 | ABM1 |
| Hv 43 | ABM1 | ABM3 | ABM1 | ABM1 | ABM3 | ABM2 |
| Hv 44 | ABM1 | ABM3 | ABM1 | ABM1 | ABM2 | ABM3 |
| Hv 45 | ABM1 | ABM2 | ABM1 | ABM1 | ABM3 | ABM3 |
| Hv 46 | ABM1 | ABM3 | ABM1 | ABM3 | ABM1 | ABM2 |
| Hv 47 | ABM1 | ABM3 | ABM1 | ABM2 | ABM1 | ABM3 |
| Hv 48 | ABM1 | ABM2 | ABM1 | ABM3 | ABM1 | ABM3 |
| Hv 49 | ABM1 | ABM3 | ABM1 | ABM3 | ABM2 | ABM1 |
| Hv 50 | ABM1 | ABM3 | ABM1 | ABM2 | ABM3 | ABM1 |
| Hv 51 | ABM1 | ABM2 | ABM1 | ABM3 | ABM3 | ABM1 |
| Hv 52 | ABM1 | ABM3 | ABM3 | ABM1 | ABM1 | ABM2 |
| Hv 53 | ABM1 | ABM3 | ABM2 | ABM1 | ABM1 | ABM3 |
| Hv 54 | ABM1 | ABM2 | ABM3 | ABM1 | ABM1 | ABM3 |
| Hv 55 | ABM1 | ABM3 | ABM3 | ABM1 | ABM2 | ABM1 |
| Hv 56 | ABM1 | ABM3 | ABM2 | ABM1 | ABM3 | ABM1 |
| Hv 57 | ABM1 | ABM2 | ABM3 | ABM1 | ABM3 | ABM1 |
| Hv 58 | ABM1 | ABM3 | ABM3 | ABM2 | ABM1 | ABM1 |
| Hv 59 | ABM1 | ABM3 | ABM2 | ABM3 | ABM1 | ABM1 |
| Hv 60 | ABM1 | ABM2 | ABM3 | ABM3 | ABM1 | ABM1 |
| Hv 61 | ABM3 | ABM1 | ABM1 | ABM1 | ABM3 | ABM2 |
| Hv 62 | ABM3 | ABM1 | ABM1 | ABM1 | ABM2 | ABM3 |
| Hv 63 | ABM2 | ABM1 | ABM1 | ABM1 | ABM3 | ABM3 |
| Hv 64 | ABM3 | ABM1 | ABM1 | ABM3 | ABM1 | ABM2 |
| Hv 65 | ABM3 | ABM1 | ABM1 | ABM2 | ABM1 | ABM3 |
| Hv 66 | ABM2 | ABM1 | ABM1 | ABM3 | ABM1 | ABM3 |
| Hv 67 | ABM3 | ABM1 | ABM1 | ABM3 | ABM2 | ABM1 |
| Hv 68 | ABM3 | ABM1 | ABM1 | ABM2 | ABM3 | ABM1 |
| Hv 69 | ABM2 | ABM1 | ABM1 | ABM3 | ABM3 | ABM1 |
| Hv 70 | ABM3 | ABM1 | ABM3 | ABM1 | ABM1 | ABM2 |
| Hv 71 | ABM3 | ABM1 | ABM2 | ABM1 | ABM1 | ABM3 |
| Hv 72 | ABM2 | ABM1 | ABM3 | ABM1 | ABM1 | ABM3 |
| Hv 73 | ABM3 | ABM1 | ABM3 | ABM1 | ABM2 | ABM1 |
| Hv 74 | ABM3 | ABM1 | ABM2 | ABM1 | ABM3 | ABM1 |
| Hv 75 | ABM2 | ABM1 | ABM3 | ABM1 | ABM3 | ABM1 |
| Hv 76 | ABM3 | ABM1 | ABM3 | ABM2 | ABM1 | ABM1 |
| Hv 77 | ABM3 | ABM1 | ABM2 | ABM3 | ABM1 | ABM1 |
| Hv 78 | ABM2 | ABM1 | ABM3 | ABM3 | ABM1 | ABM1 |
| Hv 79 | ABM3 | ABM3 | ABM1 | ABM1 | ABM1 | ABM2 |
| Hv 80 | ABM3 | ABM2 | ABM1 | ABM1 | ABM1 | ABM3 |
| Hv 81 | ABM2 | ABM3 | ABM1 | ABM1 | ABM1 | ABM3 |
| Hv 82 | ABM3 | ABM3 | ABM1 | ABM1 | ABM2 | ABM1 |
| Hv 83 | ABM3 | ABM2 | ABM1 | ABM1 | ABM3 | ABM1 |
| Hv 84 | ABM2 | ABM3 | ABM1 | ABM1 | ABM3 | ABM1 |
| Hv 85 | ABM3 | ABM3 | ABM1 | ABM2 | ABM1 | ABM1 |
| Hv 86 | ABM3 | ABM2 | ABM1 | ABM3 | ABM1 | ABM1 |
| Hv 87 | ABM2 | ABM3 | ABM1 | ABM3 | ABM1 | ABM1 |
| Hv 88 | ABM3 | ABM3 | ABM2 | ABM1 | ABM1 | ABM1 |
| Hv 89 | ABM3 | ABM2 | ABM3 | ABM1 | ABM1 | ABM1 |
| Hv 90 | ABM2 | ABM3 | ABM3 | ABM1 | ABM1 | ABM1 |
| Hv 91 | ABM1 | ABM1 | ABM1 | ABM3 | ABM2 | ABM2 |
| Hv 92 | ABM1 | ABM1 | ABM1 | ABM2 | ABM3 | ABM2 |
| Hv 93 | ABM1 | ABM1 | ABM1 | ABM2 | ABM2 | ABM3 |
| Hv 94 | ABM1 | ABM1 | ABM3 | ABM1 | ABM2 | ABM2 |
| Hv 95 | ABM1 | ABM1 | ABM2 | ABM1 | ABM3 | ABM2 |
| Hv 96 | ABM1 | ABM1 | ABM2 | ABM1 | ABM2 | ABM3 |
| Hv 97 | ABM1 | ABM1 | ABM3 | ABM2 | ABM1 | ABM2 |
| Hv 98 | ABM1 | ABM1 | ABM2 | ABM3 | ABM1 | ABM2 |
| Hv 99 | ABM1 | ABM1 | ABM2 | ABM2 | ABM1 | ABM3 |
| Hv 100 | ABM1 | ABM1 | ABM3 | ABM2 | ABM2 | ABM1 |
| Hv 101 | ABM1 | ABM1 | ABM2 | ABM3 | ABM2 | ABM1 |
| Hv 102 | ABM1 | ABM1 | ABM2 | ABM2 | ABM3 | ABM1 |
| Hv 103 | ABM1 | ABM3 | ABM1 | ABM1 | ABM2 | ABM2 |
| Hv 104 | ABM1 | ABM2 | ABM1 | ABM1 | ABM3 | ABM2 |
| Hv 105 | ABM1 | ABM2 | ABM1 | ABM1 | ABM2 | ABM3 |
| Hv 106 | ABM1 | ABM3 | ABM1 | ABM2 | ABM1 | ABM2 |
| Hv 107 | ABM1 | ABM2 | ABM1 | ABM3 | ABM1 | ABM2 |
| Hv 108 | ABM1 | ABM2 | ABM1 | ABM2 | ABM1 | ABM3 |
| Hv 109 | ABM1 | ABM3 | ABM1 | ABM2 | ABM2 | ABM1 |
| Hv 110 | ABM1 | ABM2 | ABM1 | ABM3 | ABM2 | ABM1 |
| Hv 111 | ABM1 | ABM2 | ABM1 | ABM2 | ABM3 | ABM1 |
| Hv 112 | ABM1 | ABM3 | ABM2 | ABM1 | ABM1 | ABM2 |
| Hv 113 | ABM1 | ABM2 | ABM3 | ABM1 | ABM1 | ABM2 |
| Hv 114 | ABM1 | ABM2 | ABM2 | ABM1 | ABM1 | ABM3 |
| Hv 115 | ABM1 | ABM3 | ABM2 | ABM1 | ABM2 | ABM1 |
| Hv 116 | ABM1 | ABM2 | ABM3 | ABM1 | ABM2 | ABM1 |
| Hv 117 | ABM1 | ABM2 | ABM2 | ABM1 | ABM3 | ABM1 |

TABLE 11-continued

ABM Permutations in Hexavalent TBMs

| Hexavalent Configuration | X | Y | Z | A | B | C |
|---|---|---|---|---|---|---|
| Hv 118 | ABM1 | ABM3 | ABM2 | ABM2 | ABM1 | ABM1 |
| Hv 119 | ABM1 | ABM2 | ABM3 | ABM2 | ABM1 | ABM1 |
| Hv 120 | ABM1 | ABM2 | ABM2 | ABM3 | ABM1 | ABM1 |
| Hv 121 | ABM3 | ABM1 | ABM1 | ABM1 | ABM2 | ABM2 |
| Hv 122 | ABM2 | ABM1 | ABM1 | ABM1 | ABM3 | ABM2 |
| Hv 123 | ABM2 | ABM1 | ABM1 | ABM2 | ABM1 | ABM3 |
| Hv 124 | ABM3 | ABM1 | ABM1 | ABM2 | ABM1 | ABM2 |
| Hv 125 | ABM2 | ABM1 | ABM1 | ABM3 | ABM1 | ABM2 |
| Hv 126 | ABM2 | ABM1 | ABM1 | ABM2 | ABM1 | ABM3 |
| Hv 127 | ABM3 | ABM1 | ABM1 | ABM2 | ABM2 | ABM1 |
| Hv 128 | ABM2 | ABM1 | ABM1 | ABM3 | ABM2 | ABM1 |
| Hv 129 | ABM2 | ABM1 | ABM1 | ABM2 | ABM3 | ABM1 |
| Hv 130 | ABM3 | ABM1 | ABM2 | ABM1 | ABM1 | ABM2 |
| Hv 131 | ABM2 | ABM1 | ABM3 | ABM1 | ABM1 | ABM2 |
| Hv 132 | ABM2 | ABM1 | ABM2 | ABM1 | ABM1 | ABM3 |
| Hv 133 | ABM3 | ABM1 | ABM2 | ABM1 | ABM2 | ABM1 |
| Hv 134 | ABM2 | ABM1 | ABM3 | ABM1 | ABM2 | ABM1 |
| Hv 135 | ABM2 | ABM1 | ABM2 | ABM1 | ABM3 | ABM1 |
| Hv 136 | ABM3 | ABM1 | ABM2 | ABM2 | ABM1 | ABM1 |
| Hv 137 | ABM2 | ABM1 | ABM3 | ABM2 | ABM1 | ABM1 |
| Hv 138 | ABM2 | ABM1 | ABM2 | ABM3 | ABM1 | ABM1 |
| Hv 139 | ABM3 | ABM2 | ABM1 | ABM1 | ABM1 | ABM2 |
| Hv 140 | ABM2 | ABM3 | ABM1 | ABM1 | ABM1 | ABM2 |
| Hv 141 | ABM2 | ABM2 | ABM1 | ABM1 | ABM1 | ABM3 |
| Hv 142 | ABM3 | ABM2 | ABM1 | ABM1 | ABM2 | ABM1 |
| Hv 143 | ABM2 | ABM3 | ABM1 | ABM1 | ABM2 | ABM1 |
| Hv 144 | ABM2 | ABM2 | ABM1 | ABM1 | ABM3 | ABM1 |
| Hv 145 | ABM3 | ABM2 | ABM1 | ABM2 | ABM1 | ABM1 |
| Hv 146 | ABM2 | ABM3 | ABM1 | ABM2 | ABM1 | ABM1 |
| Hv 147 | ABM2 | ABM2 | ABM1 | ABM3 | ABM1 | ABM1 |
| Hv 148 | ABM3 | ABM2 | ABM2 | ABM1 | ABM1 | ABM1 |
| Hv 149 | ABM2 | ABM3 | ABM2 | ABM1 | ABM1 | ABM1 |
| Hv 150 | ABM2 | ABM2 | ABM3 | ABM1 | ABM1 | ABM1 |
| Hv 151 | ABM1 | ABM1 | ABM3 | ABM3 | ABM2 | ABM2 |
| Hv 152 | ABM1 | ABM1 | ABM3 | ABM2 | ABM3 | ABM2 |
| Hv 153 | ABM1 | ABM1 | ABM3 | ABM2 | ABM2 | ABM3 |
| Hv 154 | ABM1 | ABM1 | ABM2 | ABM3 | ABM3 | ABM2 |
| Hv 155 | ABM1 | ABM1 | ABM2 | ABM3 | ABM2 | ABM3 |
| Hv 156 | ABM1 | ABM1 | ABM2 | ABM2 | ABM3 | ABM3 |
| Hv 157 | ABM1 | ABM3 | ABM1 | ABM3 | ABM2 | ABM2 |
| Hv 158 | ABM1 | ABM3 | ABM1 | ABM2 | ABM3 | ABM2 |
| Hv 159 | ABM1 | ABM3 | ABM1 | ABM2 | ABM2 | ABM3 |
| Hv 160 | ABM1 | ABM2 | ABM1 | ABM3 | ABM3 | ABM2 |
| Hv 161 | ABM1 | ABM2 | ABM1 | ABM3 | ABM2 | ABM3 |
| Hv 162 | ABM1 | ABM2 | ABM1 | ABM2 | ABM3 | ABM3 |
| Hv 163 | ABM1 | ABM3 | ABM3 | ABM1 | ABM2 | ABM2 |
| Hv 164 | ABM1 | ABM3 | ABM2 | ABM1 | ABM3 | ABM2 |
| Hv 165 | ABM1 | ABM3 | ABM2 | ABM1 | ABM2 | ABM3 |
| Hv 166 | ABM1 | ABM2 | ABM3 | ABM1 | ABM3 | ABM2 |
| Hv 167 | ABM1 | ABM2 | ABM3 | ABM1 | ABM2 | ABM3 |
| Hv 168 | ABM1 | ABM2 | ABM2 | ABM1 | ABM3 | ABM3 |
| Hv 169 | ABM1 | ABM3 | ABM3 | ABM2 | ABM1 | ABM2 |
| Hv 170 | ABM1 | ABM3 | ABM2 | ABM3 | ABM1 | ABM2 |
| Hv 171 | ABM1 | ABM3 | ABM2 | ABM2 | ABM1 | ABM3 |
| Hv 172 | ABM1 | ABM2 | ABM3 | ABM3 | ABM1 | ABM2 |
| Hv 173 | ABM1 | ABM2 | ABM3 | ABM2 | ABM1 | ABM3 |
| Hv 174 | ABM1 | ABM2 | ABM2 | ABM3 | ABM1 | ABM3 |
| Hv 175 | ABM1 | ABM3 | ABM3 | ABM2 | ABM2 | ABM1 |
| Hv 176 | ABM1 | ABM3 | ABM2 | ABM3 | ABM2 | ABM1 |
| Hv 177 | ABM1 | ABM3 | ABM2 | ABM2 | ABM3 | ABM1 |
| Hv 178 | ABM1 | ABM2 | ABM3 | ABM3 | ABM2 | ABM1 |
| Hv 179 | ABM1 | ABM2 | ABM3 | ABM2 | ABM3 | ABM1 |
| Hv 180 | ABM1 | ABM2 | ABM2 | ABM3 | ABM3 | ABM1 |
| Hv 181 | ABM3 | ABM1 | ABM1 | ABM3 | ABM2 | ABM2 |
| Hv 182 | ABM3 | ABM1 | ABM1 | ABM2 | ABM3 | ABM2 |
| Hv 183 | ABM3 | ABM1 | ABM1 | ABM2 | ABM2 | ABM3 |
| Hv 184 | ABM2 | ABM1 | ABM1 | ABM3 | ABM3 | ABM2 |
| Hv 185 | ABM2 | ABM1 | ABM1 | ABM3 | ABM2 | ABM3 |
| Hv 186 | ABM2 | ABM1 | ABM1 | ABM2 | ABM3 | ABM3 |
| Hv 187 | ABM3 | ABM1 | ABM3 | ABM1 | ABM2 | ABM2 |
| Hv 188 | ABM3 | ABM1 | ABM2 | ABM1 | ABM3 | ABM2 |
| Hv 189 | ABM3 | ABM1 | ABM2 | ABM1 | ABM2 | ABM3 |
| Hv 190 | ABM2 | ABM1 | ABM3 | ABM1 | ABM3 | ABM2 |
| Hv 191 | ABM2 | ABM1 | ABM3 | ABM1 | ABM2 | ABM3 |
| Hv 192 | ABM2 | ABM1 | ABM2 | ABM1 | ABM3 | ABM3 |
| Hv 193 | ABM3 | ABM1 | ABM3 | ABM2 | ABM1 | ABM2 |
| Hv 194 | ABM3 | ABM1 | ABM2 | ABM3 | ABM1 | ABM2 |
| Hv 195 | ABM3 | ABM1 | ABM2 | ABM2 | ABM1 | ABM3 |
| Hv 196 | ABM2 | ABM1 | ABM3 | ABM3 | ABM1 | ABM2 |
| Hv 197 | ABM2 | ABM1 | ABM3 | ABM2 | ABM1 | ABM3 |
| Hv 198 | ABM2 | ABM1 | ABM2 | ABM3 | ABM1 | ABM3 |
| Hv 199 | ABM3 | ABM1 | ABM3 | ABM2 | ABM2 | ABM1 |
| Hv 200 | ABM3 | ABM1 | ABM2 | ABM3 | ABM2 | ABM1 |
| Hv 201 | ABM3 | ABM1 | ABM2 | ABM2 | ABM3 | ABM1 |
| Hv 202 | ABM2 | ABM1 | ABM3 | ABM3 | ABM2 | ABM1 |
| Hv 203 | ABM2 | ABM1 | ABM3 | ABM2 | ABM3 | ABM1 |
| Hv 204 | ABM2 | ABM1 | ABM2 | ABM3 | ABM3 | ABM1 |
| Hv 205 | ABM3 | ABM3 | ABM1 | ABM1 | ABM2 | ABM2 |
| Hv 206 | ABM3 | ABM2 | ABM1 | ABM1 | ABM3 | ABM2 |
| Hv 207 | ABM3 | ABM2 | ABM1 | ABM1 | ABM2 | ABM3 |
| Hv 208 | ABM2 | ABM3 | ABM1 | ABM1 | ABM3 | ABM2 |
| Hv 209 | ABM2 | ABM3 | ABM1 | ABM1 | ABM2 | ABM3 |
| Hv 210 | ABM2 | ABM2 | ABM1 | ABM1 | ABM3 | ABM3 |
| Hv 211 | ABM3 | ABM3 | ABM1 | ABM2 | ABM1 | ABM2 |
| Hv 212 | ABM3 | ABM2 | ABM1 | ABM3 | ABM1 | ABM2 |
| Hv 213 | ABM3 | ABM2 | ABM1 | ABM2 | ABM1 | ABM3 |
| Hv 214 | ABM2 | ABM3 | ABM1 | ABM3 | ABM1 | ABM2 |
| Hv 215 | ABM2 | ABM3 | ABM1 | ABM2 | ABM1 | ABM3 |
| Hv 216 | ABM2 | ABM2 | ABM1 | ABM3 | ABM1 | ABM3 |
| Hv 217 | ABM3 | ABM3 | ABM1 | ABM2 | ABM2 | ABM1 |
| Hv 218 | ABM3 | ABM2 | ABM1 | ABM3 | ABM2 | ABM1 |
| Hv 219 | ABM3 | ABM2 | ABM1 | ABM2 | ABM3 | ABM1 |
| Hv 220 | ABM2 | ABM3 | ABM1 | ABM3 | ABM2 | ABM1 |
| Hv 221 | ABM2 | ABM3 | ABM1 | ABM2 | ABM3 | ABM1 |
| Hv 222 | ABM2 | ABM2 | ABM1 | ABM3 | ABM3 | ABM1 |
| Hv 223 | ABM3 | ABM3 | ABM2 | ABM1 | ABM1 | ABM2 |
| Hv 224 | ABM3 | ABM2 | ABM3 | ABM1 | ABM1 | ABM2 |
| Hv 225 | ABM3 | ABM2 | ABM2 | ABM1 | ABM1 | ABM3 |
| Hv 226 | ABM2 | ABM3 | ABM3 | ABM1 | ABM1 | ABM2 |
| Hv 227 | ABM2 | ABM3 | ABM2 | ABM1 | ABM1 | ABM3 |
| Hv 228 | ABM2 | ABM2 | ABM3 | ABM1 | ABM1 | ABM3 |
| Hv 229 | ABM3 | ABM3 | ABM2 | ABM1 | ABM2 | ABM1 |
| Hv 230 | ABM3 | ABM2 | ABM3 | ABM1 | ABM2 | ABM1 |
| Hv 231 | ABM3 | ABM2 | ABM2 | ABM1 | ABM3 | ABM1 |
| Hv 232 | ABM2 | ABM3 | ABM3 | ABM1 | ABM2 | ABM1 |
| Hv 233 | ABM2 | ABM3 | ABM2 | ABM1 | ABM3 | ABM1 |
| Hv 234 | ABM2 | ABM2 | ABM3 | ABM1 | ABM3 | ABM1 |
| Hv 235 | ABM3 | ABM3 | ABM2 | ABM2 | ABM1 | ABM1 |
| Hv 236 | ABM3 | ABM2 | ABM3 | ABM2 | ABM1 | ABM1 |
| Hv 237 | ABM3 | ABM2 | ABM2 | ABM3 | ABM1 | ABM1 |
| Hv 238 | ABM2 | ABM3 | ABM3 | ABM2 | ABM1 | ABM1 |
| Hv 239 | ABM2 | ABM3 | ABM2 | ABM3 | ABM1 | ABM1 |
| Hv 240 | ABM2 | ABM2 | ABM3 | ABM3 | ABM1 | ABM1 |
| Hv 241 | ABM1 | ABM1 | ABM3 | ABM2 | ABM2 | ABM2 |
| Hv 242 | ABM1 | ABM1 | ABM2 | ABM3 | ABM2 | ABM2 |
| Hv 243 | ABM1 | ABM1 | ABM2 | ABM2 | ABM3 | ABM2 |
| Hv 244 | ABM1 | ABM1 | ABM2 | ABM2 | ABM2 | ABM3 |
| Hv 245 | ABM1 | ABM3 | ABM1 | ABM2 | ABM2 | ABM2 |
| Hv 246 | ABM1 | ABM2 | ABM1 | ABM3 | ABM2 | ABM2 |
| Hv 247 | ABM1 | ABM2 | ABM1 | ABM2 | ABM3 | ABM2 |
| Hv 248 | ABM1 | ABM2 | ABM1 | ABM2 | ABM2 | ABM3 |
| Hv 249 | ABM1 | ABM3 | ABM2 | ABM1 | ABM2 | ABM2 |
| Hv 250 | ABM1 | ABM2 | ABM3 | ABM1 | ABM2 | ABM2 |
| Hv 251 | ABM1 | ABM2 | ABM2 | ABM1 | ABM3 | ABM2 |
| Hv 252 | ABM1 | ABM2 | ABM2 | ABM1 | ABM2 | ABM3 |
| Hv 253 | ABM1 | ABM3 | ABM2 | ABM2 | ABM1 | ABM2 |
| Hv 254 | ABM1 | ABM2 | ABM3 | ABM2 | ABM1 | ABM2 |
| Hv 255 | ABM1 | ABM2 | ABM2 | ABM3 | ABM1 | ABM2 |
| Hv 256 | ABM1 | ABM2 | ABM2 | ABM2 | ABM1 | ABM3 |
| Hv 257 | ABM1 | ABM3 | ABM2 | ABM2 | ABM2 | ABM1 |
| Hv 258 | ABM1 | ABM2 | ABM3 | ABM2 | ABM2 | ABM1 |
| Hv 259 | ABM1 | ABM2 | ABM2 | ABM3 | ABM2 | ABM1 |
| Hv 260 | ABM1 | ABM2 | ABM2 | ABM2 | ABM3 | ABM1 |
| Hv 261 | ABM3 | ABM1 | ABM1 | ABM2 | ABM2 | ABM2 |
| Hv 262 | ABM2 | ABM1 | ABM1 | ABM3 | ABM2 | ABM2 |
| Hv 263 | ABM2 | ABM1 | ABM1 | ABM2 | ABM3 | ABM2 |
| Hv 264 | ABM2 | ABM1 | ABM1 | ABM2 | ABM2 | ABM3 |
| Hv 265 | ABM3 | ABM1 | ABM2 | ABM1 | ABM2 | ABM2 |
| Hv 266 | ABM2 | ABM1 | ABM3 | ABM1 | ABM2 | ABM2 |
| Hv 267 | ABM2 | ABM1 | ABM2 | ABM1 | ABM3 | ABM2 |

TABLE 11-continued

ABM Permutations in Hexavalent TBMs

| Hexavalent Configuration | X | Y | Z | A | B | C |
|---|---|---|---|---|---|---|
| Hv 268 | ABM2 | ABM1 | ABM2 | ABM1 | ABM2 | ABM3 |
| Hv 269 | ABM3 | ABM1 | ABM2 | ABM2 | ABM1 | ABM2 |
| Hv 270 | ABM2 | ABM1 | ABM3 | ABM2 | ABM1 | ABM2 |
| Hv 271 | ABM2 | ABM1 | ABM2 | ABM3 | ABM1 | ABM2 |
| Hv 272 | ABM2 | ABM1 | ABM2 | ABM2 | ABM1 | ABM3 |
| Hv 273 | ABM3 | ABM1 | ABM2 | ABM2 | ABM2 | ABM1 |
| Hv 274 | ABM2 | ABM1 | ABM3 | ABM2 | ABM2 | ABM1 |
| Hv 275 | ABM2 | ABM1 | ABM2 | ABM3 | ABM2 | ABM1 |
| Hv 276 | ABM2 | ABM1 | ABM2 | ABM2 | ABM3 | ABM1 |
| Hv 277 | ABM3 | ABM2 | ABM1 | ABM1 | ABM2 | ABM2 |
| Hv 278 | ABM2 | ABM3 | ABM1 | ABM1 | ABM2 | ABM2 |
| Hv 279 | ABM2 | ABM2 | ABM1 | ABM1 | ABM3 | ABM2 |
| Hv 280 | ABM2 | ABM2 | ABM1 | ABM1 | ABM2 | ABM3 |
| Hv 281 | ABM3 | ABM2 | ABM1 | ABM2 | ABM1 | ABM2 |
| Hv 282 | ABM2 | ABM3 | ABM1 | ABM2 | ABM1 | ABM2 |
| Hv 283 | ABM2 | ABM2 | ABM1 | ABM3 | ABM1 | ABM2 |
| Hv 284 | ABM2 | ABM2 | ABM1 | ABM2 | ABM1 | ABM3 |
| Hv 285 | ABM3 | ABM2 | ABM1 | ABM2 | ABM2 | ABM1 |
| Hv 286 | ABM2 | ABM3 | ABM1 | ABM2 | ABM2 | ABM1 |
| Hv 287 | ABM2 | ABM2 | ABM1 | ABM3 | ABM2 | ABM1 |
| Hv 288 | ABM2 | ABM2 | ABM1 | ABM2 | ABM3 | ABM1 |
| Hv 289 | ABM3 | ABM2 | ABM2 | ABM1 | ABM1 | ABM2 |
| Hv 290 | ABM2 | ABM3 | ABM2 | ABM1 | ABM1 | ABM2 |
| Hv 291 | ABM2 | ABM2 | ABM3 | ABM1 | ABM1 | ABM2 |
| Hv 292 | ABM2 | ABM2 | ABM2 | ABM1 | ABM1 | ABM3 |
| Hv 293 | ABM3 | ABM2 | ABM2 | ABM1 | ABM2 | ABM1 |
| Hv 294 | ABM2 | ABM3 | ABM2 | ABM1 | ABM2 | ABM1 |
| Hv 295 | ABM2 | ABM2 | ABM3 | ABM1 | ABM2 | ABM1 |
| Hv 296 | ABM2 | ABM2 | ABM2 | ABM1 | ABM3 | ABM1 |
| Hv 297 | ABM3 | ABM2 | ABM2 | ABM2 | ABM1 | ABM1 |
| Hv 298 | ABM2 | ABM3 | ABM2 | ABM2 | ABM1 | ABM1 |
| Hv 299 | ABM2 | ABM2 | ABM3 | ABM2 | ABM1 | ABM1 |
| Hv 300 | ABM2 | ABM2 | ABM2 | ABM3 | ABM1 | ABM1 |
| Hv 301 | ABM1 | ABM3 | ABM2 | ABM2 | ABM2 | ABM2 |
| Hv 302 | ABM1 | ABM2 | ABM3 | ABM2 | ABM2 | ABM2 |
| Hv 303 | ABM1 | ABM2 | ABM2 | ABM3 | ABM2 | ABM2 |
| Hv 304 | ABM1 | ABM2 | ABM2 | ABM2 | ABM3 | ABM2 |
| Hv 305 | ABM1 | ABM2 | ABM2 | ABM2 | ABM2 | ABM3 |
| Hv 306 | ABM3 | ABM1 | ABM2 | ABM2 | ABM2 | ABM2 |
| Hv 307 | ABM2 | ABM1 | ABM3 | ABM2 | ABM2 | ABM2 |
| Hv 308 | ABM2 | ABM1 | ABM2 | ABM3 | ABM2 | ABM2 |
| Hv 309 | ABM2 | ABM1 | ABM2 | ABM2 | ABM3 | ABM2 |
| Hv 310 | ABM2 | ABM1 | ABM2 | ABM2 | ABM2 | ABM3 |
| Hv 311 | ABM3 | ABM2 | ABM1 | ABM2 | ABM2 | ABM2 |
| Hv 312 | ABM2 | ABM3 | ABM1 | ABM2 | ABM2 | ABM2 |
| Hv 313 | ABM2 | ABM2 | ABM1 | ABM3 | ABM2 | ABM2 |
| Hv 314 | ABM2 | ABM2 | ABM1 | ABM2 | ABM3 | ABM2 |
| Hv 315 | ABM2 | ABM2 | ABM1 | ABM2 | ABM2 | ABM3 |
| Hv 316 | ABM3 | ABM2 | ABM2 | ABM1 | ABM2 | ABM2 |
| Hv 317 | ABM2 | ABM3 | ABM2 | ABM1 | ABM2 | ABM2 |
| Hv 318 | ABM2 | ABM2 | ABM3 | ABM1 | ABM2 | ABM2 |
| Hv 319 | ABM2 | ABM2 | ABM2 | ABM1 | ABM3 | ABM2 |
| Hv 320 | ABM2 | ABM2 | ABM2 | ABM1 | ABM2 | ABM3 |
| Hv 321 | ABM3 | ABM2 | ABM2 | ABM2 | ABM1 | ABM2 |
| Hv 322 | ABM2 | ABM3 | ABM2 | ABM2 | ABM1 | ABM2 |
| Hv 323 | ABM2 | ABM2 | ABM3 | ABM2 | ABM1 | ABM2 |
| Hv 324 | ABM2 | ABM2 | ABM2 | ABM3 | ABM1 | ABM2 |
| Hv 325 | ABM2 | ABM2 | ABM2 | ABM2 | ABM1 | ABM3 |
| Hv 326 | ABM3 | ABM2 | ABM2 | ABM2 | ABM2 | ABM1 |
| Hv 327 | ABM2 | ABM3 | ABM2 | ABM2 | ABM2 | ABM1 |
| Hv 328 | ABM2 | ABM2 | ABM3 | ABM2 | ABM2 | ABM1 |
| Hv 329 | ABM2 | ABM2 | ABM2 | ABM3 | ABM2 | ABM1 |
| Hv 330 | ABM2 | ABM2 | ABM2 | ABM2 | ABM3 | ABM1 |

7.9. TCR ABMs

The MBMs of the disclosure contain an ABM1 comprising a variant CD58 domain that specifically binds to CD2 and an ABM2 which is specific for a different antigen. In the BBMs and TBMs of the disclosure, ABM2 can bind to, for example, a component of a TCR complex. The TCR is a disulfide-linked membrane-anchored heterodimeric protein normally consisting of the highly variable alpha ($\alpha$) and beta ($\beta$) chains expressed as part of a complex with the invariant CD3 chain molecules. T cells expressing this receptor are referred to as $\alpha$:$\beta$ (or $\alpha\beta$) T cells, though a minority of T cells express an alternate receptor, formed by variable gamma ($\gamma$) and delta ($\delta$) chains, referred as $\gamma\delta$ T cells.

In an embodiment, MBMs contain an ABM that specifically binds to CD3.

7.9.1. CD3 ABMs

The MBMs can contain an ABM that specifically binds to CD3. The term "CD3" refers to the cluster of differentiation 3 co-receptor (or co-receptor complex, or polypeptide chain of the co-receptor complex) of the T cell receptor. The amino acid sequence of the polypeptide chains of human CD3 are provided in NCBI Accession P04234, P07766 and P09693. CD3 proteins can also include variants. CD3 proteins can also include fragments. CD3 proteins also include post-translational modifications of the CD3 amino acid sequences. Post-translational modifications include, but are not limited to, N- and O-linked glycosylation.

In some embodiments, a MBM can comprise an ABM which is an anti-CD3 antibody (e.g., as described in US 2016/0355600, WO 2014/110601, and WO 2014/145806) or an antigen-binding domain thereof. Exemplary anti-CD3 VH, VL, and scFV sequences that can be used in a MBM are provided in Table 12A.

TABLE 12A

CD3 Binders - Variable domain sequences

| Binding Domain | Chain | Sequence | SEQ ID NO: |
|---|---|---|---|
| CD3-1 | VH | QVQLQQSGAELARPGASVKMSCKASGYTFTRYTMHWVKQRPGQG LEWIGYINPSRGYTNYNQKFKDKATLTTDKSSSTAYMQLSSLTSEDS AVYYCARYYDDHYCLDYWGQGTTLTVSS | 799 |
|  | VL | QIVLTQSPAIMSASPGEKVTMTCSASSSVSYMNWYQQKSGTSPKR WIYDTSKLASGVPAHFRGSGSGTSYSLTISGMEAEDAATYYCQQWS SNPFTFGSGTKLEIN | 800 |
| CD3-2 | VH | EVQLVESGGGLVQPKGSLKLSCAASGFTFNTYAMNWVRQAPGKGL EWVARIRSKYNNYATYYADSVKDRFTISRDDSQSILYLQMNNLKTED TAMYYCVRHGNFGNSYVSWFAYWGQGTLVTVSA | 801 |

TABLE 12A-continued

CD3 Binders - Variable domain sequences

| Binding Domain | Chain | Sequence | SEQ ID NO: |
|---|---|---|---|
| | VL | QAVVTQESALTTSPGETVTLTCRSSTGAVTTSNYANWVQEKPDHLF TGLIGGTNKRAPGVPARFSGSLIGDKAALTITGAQTEDEAIYFCALWY SNLWVFGGGTKLTVL | 802 |
| CD3-3 | VH | QVQLQQSGAELARPGASVKMSCKASGYTFTSYTMHWVKQRPGQG LEWIGYINPSSGYTKYNQKFKDKATLTADKSSSTAYMQLSSLTSEDS AVYYCARWQDYDVYFDYWGQGTTLTVSS | 803 |
| | VL | QIVLSQSPAILSASPGEKVTMTCRASSSVSYMHWYQQKPGSSPKPW IYATSNLASGVPARFSGSGSGTSYSLTISRVEAEDAATYYCQQWSSN PPTFGGGTKLETK | 804 |
| CD3-4 | VH | QVQLQQSGAELARPGASVKMSCKASGYTFTRYTMHWVKQRPGQG LEWIGYINPSRGYTNYNQKFKDKATLTTDKSSSTAYMQLSSLTSEDS AVYYCARYYDDHYCLDYWGQGTTLTVSS | 799 |
| | VL | QIVLTQSPAIMSASPGEKVTMTCRASSSVSYMNWYQQKSGTSPKR WIYDTSKVASGVPYRFSGSGSGTSYSLTISSMEAEDAATYYCQQWS SNPLTFGSGTKLEIN | 805 |
| CD3-5 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYCLDYWGQGTPVTVSS | 806 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWSS NPFTFGQGTKLQIT | 807 |
| CD3-6 | VH | QVQLVESGGGVVQPGRSLRLSCAASGFKFSGYGMHWVRQAPGKG LEWVAVIWYDGSKKYYVDSVKGRFTISRDNSKNTLYLQMNSLRAED TAVYYCARQMGYWHFDLWGRGTLVTVSS | 808 |
| | VL | EIVLTQSPATLSLSPGERATLSCRASQSVSSYLAWYQQKPGQAPRLL IYDASNRATGIPARFSGSGSGTDFTLTISSLEPEDFAVYYCQQRSNW PPLTFGGGTKVEIK | 809 |
| CD3-7 | VH | EVQLVESGGGLVQPGGSLRLSCAASGFTFSTYAMNWVRQAPGKGL EWVGRIRSKYNNYATYYADSVKDRFISRDDSKNSLYLQMNSLKTED TAVYYCVRHGNFGNSYVSWFAYWGQGTLVTVSS | 810 |
| | VL | QAVVTQEPSLTVSPGGTVTLTCRSSTGAVTTSNYANWVQQKPGQA PRGLIGGTNKRAPWTPARFSGSLLGGKAALIGAQAEDEADYYCALW YSNLWVFGGGTKLTVL | 811 |
| CD3-8 | VH | DIKLQQSGAELARPGASVKMSCKTSGYTFTRYTMHWVKQRPGQGL EWIGYINPSRGYTNYNQKFKDKATLTTDKSSSTAYMQLSSLTSEDSA VYYCARYYDDHYCLDYWGQGTTLTVSS | 812 |
| | VL | DIQLTQSPAIMSASPGEKVTMTCRASSSVSYMNWYQQKSGTSPKR WIYDTSKVASGVPYRFSGSGSGTSYSLISSMEAEDAATYYCQQWSS NPLTFGAGTKLELK | 813 |
| CD3-9 | VH | EVQLVESGGGLVQPGGSLRLSCAASGFTFNTYAMNWVRQAPGKGL EWVARIRSKYNNYATYYADSVKDRFISRDDSKNSLYLQMNSLKTEDT AVYYCVRHGNFGNSYVSWFAYWGQGTLVTVSS | 814 |
| | VL | QAVVTQEPSLTVSPGGTVTLTCRSSTGAVTTSNYANWVQQKPGQA PRGLIGGTNKRAPWTPARFSGSLLGGKAALIGAQAEDEADYYCALW YSNLWVFGGGTKLTVL | 811 |
| CD3-10 | VH | EVKLLESGGGLVQPKGSLKLSCAASGFTFNTYAMNWVRQAPGKGL EWVARIRSKYNNYATYYADSVKDRFTISRDDSQSILYLQMNNLKTED TAMYYCVRHGNFGNSYVSWFAYWGQGTLVTVSA | 815 |
| | VL | QAVVTQESALTTSPGETVTLTCRSSTGAVTTSNYANWVQEKPDHLF TGLIGGTNKRAPGVPARFSGSLIGDKAALTITGAQTEDEAIYFCALWY SNLWVFGGGTKLTVL | 802 |
| CD3-11 | VH | EVQLVESGGGLVQPGGSLKLSCAASGFTFNSYAMNWVRQAPGKGL EWVARIRSKYNNYATYYADSVKGRFTISRDDSKNTAYLQMNNLKTE DTAVYYCVRHGNFGNSYVSWVAYWGQGTLVTVSS | 816 |
| | VL | QTVVTQEPSLTVSPGGTVTLTCGSSTGAVTSGNYPNWVQQKPGQA PRGLIGGTKFLAPGTPQRFSGSLLGGKAALTLSGVQPEDEAEYYCVL WYSNRWVFGGGTKLTVL | 817 |
| CD3-12 | VH | EVQLVESGGGLVQPGGSLKLSCAASGFTFNKYAMNWVRQAPGKGL EWVARIRSKYNNYATYYADSVKDRFTISRDDSKNTAYLQMNNLKTE DTAVYYCVRHGNFGNSYISYWAYWGQGTLVTVSS | 818 |
| | VL | QTVVTQEPSLTVSPGGTVTLTCGSSTGAVTSGNYPNWVQQKPGQA PRGLIGGTKFLAPGTPARFSGSLLGGKAALTLSGVQPEDEAEYYCVL WYSNRWVFGGGTKLTVL | 819 |

TABLE 12A-continued

CD3 Binders - Variable domain sequences

| Binding Domain | Chain | Sequence | SEQ ID NO: |
|---|---|---|---|
| | scFv | EVQLVESGGGLVQPGGSLKLSCAASGFTFNKYAMNWVRQAPGKGL EWVARIRSKYNNYATYYADSVKDRFTISRDDSKNTAYLQMNNLKTE DTAVYYCVRHGNFGNSYISYWAYWGQGTLVTVSSGGGGSGGGGS GGGGSGGGGSQTVVTQEPSLTVSPGGTVTLTCGSSTGAVTSGNYP NWVQQKPGQAPRGLIGGTKFLAPGTPARFSGSLLGGKAALTLSGVQ PEDEAEYYCVLWYSNRWVFGGGTKLTVL | 820 |
| CD3-13 | VH | QVQLVQSGAEVKKPGASVKVSCKASGYTFTRYTMHWVRQAPGQGL EWMGYINPSRGYTNYNQKFKDRVTMTTDTSISTAYMELSRLRSDDT AVYYCARYYDDHYCLDYWGQGTLVTVSS | 821 |
| | VL | EIVLTQSPATLSLSPGERATLSCSASSSVSYMNWYQQKPGQAPRLLI YDTSKLASGVPAHFRGSGSGTDFTLTISSLEPEDFAVYYCQQWSSN PFTFGQGTKVEIK | 822 |
| CD3-14 | VH | EVQLVESGGGLVQPGGSLRLSCAASGFTFSTYAMNWVRQAPGKGL EWVSRIRSKYNNYATYYADSVKDRFTISRDDSKNTLYLQMNSLRAED TAVYYCARHGNFGNSYVSWFAYWGQGTMVTVSS | 823 |
| | VL | QAVVTQEPSLTVSPGGTVTLTCRSSTGAVTTSNYANWVQQKPGQA PRGLIGGTNKRAPGTPARFSGSLLGGKAALTLSGVQPEDEAEYYCA LWYSNLWVFGGGTKLTVL | 824 |
| CD3-15 | VH | EVQLVESGGGLVQPGGSLRLSCAASGFTFNTYAMNWVRQAPGKGL EWVGRIRSKYNNYATYYADSVKDRFTISRDDSKNSLYLQMNSLKTE DTAVYYCVRHGNFGNSYVSWFAYWGQGTLVTVSS | 825 |
| | VL | QAVVTQEPSLTVSPGGTVTLTCRSSTGAVTTSNYANWVQEKPGQA PRGLIGGTNKRAPWTPARFSGSLLGGKAALTITGAQAEDEADYYCAL VVYSNLWVFGGGTKLTVL | 826 |
| CD3-16 | VH | EVQLVESGGGLVQPGGSLRLSCAASGFTFNTYAMNWVRQAPGKGL EWVGRIRSKYNNYATYYADSVKGRFTISRDDSKNTLYLQMNSLRAE DTAVYYCVRHGNFGNSYVSWFAYWGQGTLVTVSS | 827 |
| | VL | QAVVTQEPSLTVSPGGTVTLTCGSSTGAVTTSNYANWVQQKPGQA PRGLIGGTNKRAPGVPARFSGSLLGGKAALTLSGAQPEDEAEYYCA LWYSNLWVFGGGTKLTVL | 828 |
| CD3-17 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSS | 829 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL VVYSNHWVFGGGTKLTVL | 830 |
| CD3-18 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYCLDYWGQGTPVTVSS | 806 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWSS NPFTFGQGT | 831 |
| CD3-19 | VH | QVQLVQSGGGVVQPGRSLRLSCKASGYTFTRYTMHWVRQAPGKG LEWIGYINPSRGYTNYNQKVKDRFTISRDNSKNTAFLQMDSLRPEDT GVYFCARYYDDHYSLDYWGQGTPVTVSS | 832 |
| | VL | DIQMTQSPSSLSASVGDRVTITCSASSSVSYMNWYQQTPGKAPKR WIYDTSKLASGVPSRFSGSGSGTDYTFTISSLQPEDIATYYCQQWSS NPFTFGQGT | 831 |
| CD3-20 | VH | EVQLQQSGPELVKPGASMKISCKASGYSFTGYTMNWVKQSHGKNL EWMGLINPYKGVSTYNQKFKDKATLTVDKSSSTAYMELLSLTSEDSA VYYCARSGYYGDSDWYFDVWGQGTTLTVFS | 833 |
| | VL | DIQMTQTTSSLSASLGDRVTISCRASQDIRNYLNWYQQKPDGTVKLL IYYTSRLHSGVPSKFSGSGSGTDYSLTISNLEQEDIATYFCQQGNTLP WTFAGGTKLEIK | 834 |
| CD3-21 | VH | EVQLVESGGGLVQPGGSLKLSCAASGFTFNTYAMNWVRQASGKGL EWVGRIRSKYNNYATYYADSVKDRFTISRDDSKSTLYLQMNSLKTED TAVYYCVRHGNFGNSYVSWFAYWGQGTLVTVSS | 835 |
| | VL | QAVVTQEPSLTVSPGGTVTLTCRSSTGAVTTSNYANWVQQKPGQA PRGLIGGTNKRAPWTPARFSGSLLGDKAALTLSGAQPEDEAEYFCA LWYSNLWVFGGGTKLTVL | 836 |
| | scFv | EVQLVESGGGLVQPGGSLKLSCAASGFTFNTYAMNWVRQASGKGL EWVGRIRSKYNNYATYYADSVKDRFTISRDDSKSTLYLQMNSLKTED TAVYYCVRHGNFGNSYVSWFAYWGQGTLVTVSSGGGGSGGGGSG | 837 |

TABLE 12A-continued

CD3 Binders - Variable domain sequences

| Binding Domain | Chain | Sequence | SEQ ID NO: |
|---|---|---|---|
| | | GGGSGGGGSQAVVTQEPSLTVSPGGTVTLTCRSSTGAVTTSNYAN WVQQKPGQAPRGLIGGTNKRAPWTPARFSGSLLGDKAALTLSGAQ PEDEAEYFCALWYSNLWVFGGGTKLTVL | |
| CD3-22 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSS | 829 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL WYSNHWVFGGGTKLTVL | 830 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFAYWGQGTLVTVSSGKPGSGKPGS GKPGSGKPGSQAVVTQEPSLTVSPGGTVTLTCGSSTGAVTTSNYAN WVQQKPGKSPRGLIGGTNKRAPGVPARFSGSLLGGKAALTISGAQP EDEADYYCALWYSNHWVFGGGTKLTVL | 838 |
| CD3-23 | VH | EVQLVESGGGLVQPGGSLRLSCAASGFTFSTYAMNWVRQAPGKGL EWVGRIRSKANNYATYYADSVKGRFTISRDDSKNTLYLQMNSLRAE DTAVYYCVRHGNFGDSYVSWFAYWGQGTLVTVSS | 839 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL WYSNHWVFGGGTKLTVL | 830 |
| | scFv | EVQLVESGGGLVQPGGSLRLSCAASGFTFSTYAMNWVRQAPGKGL EWVGRIRSKANNYATYYADSVKGRFTISRDDSKNTLYLQMNSLRAE DTAVYYCVRHGNFGDSYVSWFAYWGQGTLVTVSSGKPGSGKPGS GKPGSGKPGSQAVVTQEPSLTVSPGGTVTLTCGSSTGAVTTSNYAN WVQQKPGKSPRGLIGGTNKRAPGVPARFSGSLLGGKAALTISGAQP EDEADYYCALWYSNHWVFGGGTKLTVL | 840 |
| CD3-24 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDEYVSWFAYWGQGTLVTVSS | 841 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL WYSNHWVFGGGTKLTVL | 830 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDEYVSWFAYWGQGTLVTVSSGKPGSGKPGS GKPGSGKPGSQAVVTQEPSLTVSPGGTVTLTCGSSTGAVTTSNYAN WVQQKPGKSPRGLIGGTNKRAPGVPARFSGSLLGGKAALTISGAQP EDEADYYCALWYSNHWVFGGGTKLTVL | 842 |
| CD3-25 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDPYVSWFAYWGQGTLVTVSS | 843 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL WYSNHWVFGGGTKLTVL | 830 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDPYVSWFAYWGQGTLVTVSSGKPGSGKPGS GKPGSGKPGSQAVVTQEPSLTVSPGGTVTLTCGSSTGAVTTSNYAN WVQQKPGKSPRGLIGGTNKRAPGVPARFSGSLLGGKAALTISGAQP EDEADYYCALWYSNHWVFGGGTKLTVL | 844 |
| CD3-26 | VH | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFDYWGQGTLVTVSS | 845 |
| | VL | QAVVTQEPSLTVSPGGTVTLTCGSSTGAVTTSNYANWVQQKPGKS PRGLIGGTNKRAPGVPARFSGSLLGGKAALTISGAQPEDEADYYCAL WYSNHWVFGGGTKLTVL | 830 |
| | scFv | EVQLVESGGGLVQPGGSLRLSCAASGFTFSTYAMNWVRQAPGKGL EWVGRIRSKYNNYATYYADSVKGRFTISRDDSKNTLYLQMNSLRAE DTAVYYCVRHGNFGDSYVSWFDYWGQGTLVTVSSGKPGSGKPGS GKPGSGKPGSQAVVTQEPSLTVSPGGTVTLTCGSSTGAVTTSNYAN WVQQKPGKSPRGLIGGTNKRAPGVPARFSGSLLGGKAALTISGAQP EDEADYYCALWYSNHWVFGGGTKLTVL | 846 |
| CD3-27 | VH | EVQLVESGGGLVQPGGSLRLSCAASGFTFSTYAMSWVRQAPGKGL EWVGRIRSKYNNYATYYADSVKGRFTISRDDSKNTLYLQMNSLRAE DTAVYYCVRHGNFGDSYVSWFAYWGQGTLVTVSS | 847 |

TABLE 12A-continued

CD3 Binders - Variable domain sequences

| Binding Domain | Chain | Sequence | SEQ ID NO: |
|---|---|---|---|
| | VL | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 830 |
| | scFv | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 848 |
| CD3-28 | VH | EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS | 827 |
| | VL | QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL | 828 |
| | scFv | EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH | 849 |
| CD3-129 | VH | EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSS | 850 |
| | VL | QAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL | 851 |
| | scFv | EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSSGGGGSGGGGSGGGGSQAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL | 852 |
| CD3-130 | VH | EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSS | 853 |
| | VL | QAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL | 836 |
| | scFv | EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL | 854 |

CDR sequences for a number of CD3 binders as defined by the Kabat numbering scheme (Kabat et al, 1991, Sequences of Proteins of Immunological Interest, 5th Ed. Public Health Service, National Institutes of Health, Bethesda, Md.), Chothia numbering scheme (Al-Lazikani et al., 1997, J. Mol. Biol 273:927-948), and a combination of Kabat and Chothia numbering are provided in Tables 12B-12D, respectively.

TABLE 12B

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-1 | VH | RYTMH | 855 | YINPSRGYTNYNQKFKD | 875 | YYDDHYCLDY | 898 |
| | VL | SASSSVSYMN | 856 | DTSKLAS | 876 | QQWSSNPFT | 899 |
| CD3-2 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-3 | VH | SYTMH | 859 | YINPSSGYTKYNQKFKD | 879 | WQDYDVYFDY | 902 |
| | VL | RASSSVSYMH | 860 | ATSNLAS | 880 | QQWSSNPPT | 903 |
| CD3-4 | VH | RYTMH | 855 | YINPSRGYTNYNQKFKD | 875 | YYDDHYCLDY | 898 |
| | VL | RASSSVSYMN | 861 | DTSKVAS | 881 | QQWSSNPLT | 904 |
| CD3-5 | VH | RYTMH | 855 | YINPSRGYTNYNQKVKD | 882 | YYDDHYCLDY | 898 |
| | VL | SASSSVSYMN | 856 | DTSKLAS | 876 | QQWSSNPFT | 899 |
| CD3-6 | VH | GYGMH | 862 | VIWYDGSKKYYVDSVKG | 883 | QMGYWHFDL | 905 |
| | VL | RASQSVSSYLA | 863 | DASNRAT | 158 | QQRSNWPPLT | 906 |
| CD3-7 | VH | TYAMN | 857 | RIRSKYNNYATYYAD | 884 | VRHGNFGNSYVSWFAY | 907 |
| | VL | RSSTGAVTTSNYAN | 858 | GTNKRAP | 878 | ALWYSNLWV | 901 |
| CD3-8 | VH | RYTMH | 855 | YINPSRGYTNYNQKFKD | 875 | YYDDHYCLDY | 898 |
| | VL | RASSSVSYMN | 861 | DTSKVAS | 881 | QQWSSNPLT | 904 |
| CD3-9 | VH | TYAMN | 857 | RIRSKYNNYATYYAD | 884 | VRHGNFGNSYVSWFAY | 907 |
| | VL | RSSTGAVTTSNYAN | 858 | GTNKRAP | 878 | ALWYSNLWV | 901 |
| CD3-10 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |
| CD3-11 | VH | SYAMN | 864 | RIRSKYNNYATYYADSVKG | 885 | HGNFGNSYVSWWAY | 908 |
| | VL | GSSTGAVTSGNYPN | 865 | GTKFLAP | 886 | VLWYSNRWV | 909 |
| CD3-12 | VH | KYAMN | 866 | RIRSKYNNYATYYADSVKD | 877 | HGNFGNSYISYWAY | 910 |
| | VL | GSSTGAVTSGNYPN | 865 | GTKFLAP | 886 | VLWYSNRWV | 909 |
| CD3-13 | VH | RYTMH | 855 | YINPSRGYTNYNQKFKD | 875 | YYDDHYCLDY | 898 |
| | VL | SASSSVSYMN | 856 | DTSKLAS | 876 | QQWSSNPFT | 899 |
| CD3-14 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |
| CD3-15 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |
| CD3-16 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-17 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-18 | VH | RYTMH | 855 | YINPSRGYTNYNQKVKD | 882 | YYDDHYCLDY | 898 |
| | VL | SASSSVSYMN | 856 | DTSKLAS | 876 | QQWSSNPFT | 899 |
| CD3-19 | VH | RYTMH | 855 | YINPSRGYTNYNQKVKD | 882 | YYDDHYSLDY | 913 |
| | VL | SASSSVSYMN | 856 | DTSKLAS | 876 | QQWSSNPFT | 899 |
| CD3-20 | VH | GYTMN | 868 | LINPYKGVSTYNQKFKD | 887 | SGYYGDSDWYFDV | 914 |
| | VL | RASQDIRNYLN | 869 | YTSRLH | 888 | QQGNTLPWT | 915 |
| CD3-21 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |
| CD3-22 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-23 | VH | TYAMN | 857 | RIRSKANNYATYYADSVKG | 889 | HGNFGDSYVSWFAY | 911 |
| | VL | GSSTGAVTTSNYAN | 867 | GTNKRAP | 878 | ALWYSNHWV | 912 |
| CD3-24 | VH | TYAMN | 857 | RIRSKYNNYATYYADSVKG | 885 | HGNFGDEYVSWFAY | 916 |
| | VL | GSSTGAVTTSNYAN | 867 | GTNKRAP | 878 | ALWYSNHWV | 912 |
| CD3-25 | VH | TYAMN | 857 | RIRSKYNNYATYYADSVKG | 885 | HGNFGDPYVSWFAY | 917 |
| | VL | GSSTGAVTTSNYAN | 867 | GTNKRAP | 878 | ALWYSNHWV | 912 |
| CD3-26 | VH | TYAMN | 857 | RIRSKYNNYATYYADSVKG | 885 | HGNFGDSYVSWFDY | 918 |
| | VL | GSSTGAVTTSNYAN | 867 | GTNKRAP | 878 | ALWYSNHWV | 912 |
| CD3-27 | VH | TYAMS | 870 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-28 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-29 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-30 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-31 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-32 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-33 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-34 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-35 | VH | TYAMH | 871 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-36 | VH | TYAMS | 870 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-37 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-38 | VH | TYAMN | 857 | RIRSKANNYYATYYADSVKG | 890 | HGNFGNSYVSWFAY | 900 |
| | VL | GSSTGAVTTSNYAN | 867 | GTNKRAP | 878 | ALWYSNLWV | 901 |
| CD3-39 | VH | TYAMN | 857 | RIRSKANSYATYYADSVKG | 891 | HGNFGNSYVSWFAY | 900 |
| | VL | GSSTGAVTTSNYAN | 867 | GTNKRAP | 878 | ALWYSNLWV | 901 |
| CD3-40 | VH | TYAMN | 857 | RIRSKYNNYATAYADSVKG | 892 | HGNFGNSYVSWFAY | 900 |
| | VL | GSSTGAVTTSNYAN | 867 | GTNKRAP | 878 | ALWYSNLWV | 901 |
| CD3-41 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-42 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-43 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-44 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-45 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-46 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-47 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-48 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-49 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-50 | VH | TYAMN | 857 | RIRSKYNNYATYY ADSVKG | 885 | HGNFGDSYVS WFAY | 911 |
|  | VL | GSSTGAVT TSNYAN | 867 | GTNKRAP | 878 | ALWYSNLWV | 901 |
| CD3-51 | VH | TYAMN | 857 | RIRSKYNNYATYY ADSVKG | 885 | HGNFGQSYVS WFAY | 919 |
|  | VL | GSSTGAVT TSNYAN | 867 | GTNKRAP | 878 | ALWYSNLWV | 901 |
| CD3-52 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-53 | VH | TYAMN | 857 | RIRSKYNNYATYY ADSVKG | 885 | HGNFGNSYVS WFDY | 920 |
|  | VL | GSSTGAVT TSNYAN | 867 | GTNKRAP | 878 | ALWYSNLWV | 901 |
| CD3-54 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-55 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-56 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-57 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-58 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-59 | VH | TYAMN | 857 | RIRSKYNNYATYY ADSVKG | 885 | HGNFGNSYVS WFAY | 900 |
|  | VL | GSSTGAVT TSNYAN | 867 | GTNKRAP | 878 | ALWYSNLWV | 901 |
| CD3-60 | VH | TYAMN | 857 | RIRSKYNNYATYY ADSVKG | 885 | HGNFGNSYVS WFAY | 900 |
|  | VL | GSSTGAVT SSNYAN | 872 | GTNKRAP | 878 | ALWYSNLWV | 901 |
| CD3-61 | VH | TYAMN | 857 | RIRSKYNNYATYY ADSVKG | 885 | HGNFGNSYVS WFAY | 900 |
|  | VL | GSSTGAVT SGHYAN | 873 | GTNKRAP | 878 | ALWYSNLWV | 901 |
| CD3-62 | VH | TYAMN | 857 | RIRSKYNNYATYY ADSVKG | 885 | HGNFGNSYVS WFAY | 900 |
|  | VL | GSSTGAVT TSNYAN | 867 | DTNKRAP | 893 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-63 | VH | TYAMN | 857 | RIRSKYNNYATYYADSVKG | 885 | HGNFGNSYVSWFAY | 900 |
|  | VL | GSSTGAVTTSNYAN | 867 | GTNNRAP | 894 | ALWYSNLWV | 901 |
| CD3-64 | VH | TYAMN | 857 | RIRSKYNNYATYYADSVKG | 885 | HGNFGNSYVSWFAY | 900 |
|  | VL | GSSTGAVTTSNYAN | 867 | GTNKRAS | 895 | ALWYSNLWV | 901 |
| CD3-65 | VH | TYAMN | 857 | RIRSKYNNYATYYADSVKG | 885 | HGNFGNSYVSWFAY | 900 |
|  | VL | GSSTGAVTTSNYAN | 867 | GTSNKHS | 896 | ALWYSNLWV | 901 |
| CD3-66 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-67 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-68 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-69 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-70 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-71 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-72 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-73 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | LLWYSNLWV | 921 |
| CD3-74 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNHWV | 912 |
| CD3-75 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-76 | VH | TYAMN | 857 | RIRSKYNNYATYYADSVKG | 885 | HGNFGNSYVSWFAY | 900 |
|  | VL | RSSTGAVTTSNYAN | 858 | GTNKRAP | 878 | ALWYSNLWV | 901 |
| CD3-77 | VH | TYAMN | 857 | RIRSKYNNYATYYADSVKG | 885 | HGNFGNSYVSWFAY | 900 |
|  | VL | KSSTGAVTTSNYAN | 874 | GTNKRAP | 878 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-78 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNHWV | 912 |
| CD3-79 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-80 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-81 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-82 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-83 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-84 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-85 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-86 | VH | TYAMN | 857 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |
| CD3-87 | VH | TYAMN | 857 | RIRSKYNNYATYYADSVKG | 885 | HGNFGDSYVSWFAY | 911 |
|  | VL | GSSTGAVTTSNYAN | 867 | GTNKRAP | 878 | ALWYSNLWV | 901 |
| CD3-88 | VH | TYAMN | 857 | RIRSKYNNYATYYADSVKG | 885 | HGNFGDSYVSWFAY | 911 |
|  | VL | GSSTGAVTTSNYAN | 867 | GTNKRAP | 878 | ALWYSNLWV | 901 |
| CD3-89 | VH | TYAMN | 857 | RIRSKANNYATYYADSVKG | 889 | HGNFGDSYVSWFAY | 911 |
|  | VL | GSSTGAVTTSNYAN | 867 | GTNKRAP | 878 | ALWYSNLWV | 901 |
| CD3-90 | VH | TYAMN | 857 | RIRSKYNNYATYYADSVKG | 885 | HGNFGDSYVSWFDY | 918 |
|  | VL | GSSTGAVTTSNYAN | 867 | GTNKRAP | 878 | ALWYSNLWV | 901 |
| CD3-91 | VH | TYAMS | 870 | RIRSKANNYATYYADSVKG | 889 | HGNFGDSYVSWFDY | 918 |
|  | VL | GSSTGAVTTSNYAN | 867 | GTNKRAP | 878 | ALWYSNLWV | 901 |
| CD3-92 | VH | TYAMN | 857 | RIRSNGGYSTYYADSVKG | 897 | HGNFGNSYVSWFAY | 900 |
|  | VL | GSSTGAVTTSNYAN | 867 | GTNKRAP | 878 | ALWYSNLWV | 901 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-93 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-94 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-95 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNLWV | 901 |
| CD3-96 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-97 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-98 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-99 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-100 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-101 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-102 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-103 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-104 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-105 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-106 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-107 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-108 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-109 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-110 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-111 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-112 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-113 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-114 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-115 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-116 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-117 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-118 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-119 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-120 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-121 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-122 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |

TABLE 12B-continued

CD3 Binders - CDR sequences according to Kabat numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-123 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-124 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-125 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-126 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-127 | VH | TYAMN | 857 | RIRSKYNNYATYYADSVKG | 885 | HGNFGNSYVSWFAY | 900 |
| | VL | GSSTGAVTTSNYAN | 867 | GTNKRAP | 878 | ALWYSNHWV | 912 |
| CD3-128 | VH | TYAMN | 857 | RIRSKYNNYATYYADSVKG | 885 | HGNFGDSYVSWFAY | 911 |
| | VL | GSSTGAVTTSNYAN | 867 | GTNKRAP | 878 | ALWYSNHWV | 912 |
| CD3-129 | VH | TYAMN | 857 | RIRSKYNNYATYYADSVKD | 877 | HGNFGNSYVSWFAH | 922 |
| | VL | GSSTGAVTSSNYAN | 872 | GTNKRAP | 878 | ALWYSNLWV | 901 |
| CD3-130 | VH | TYAMN | 857 | RIRSKYNNYATYYADSVKD | 877 | HGNFGNSYVSWFAY | 900 |
| | VL | RSSTGAVTTSNYAN | 858 | GTNKRAP | 878 | ALWYSNLWV | 901 |

TABLE 12C

CD3 Binders - CDR sequences according to Chothia numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-1 | VH | GYTFTRY | 923 | NPSRGY | 936 | YYDDHYCLDY | 898 |
| | VL | SSSVSY | 924 | DTS | 937 | WSSNPF | 946 |
| CD3-2 | VH | GFTFNTY | 925 | RSKYNNYA | 938 | HGNFGNSYVSWFAY | 900 |
| | VL | STGAVTTSNY | 926 | GTN | 213 | WYSNLW | 947 |
| CD3-3 | VH | GYTFTSY | 927 | NPSSGY | 939 | WQDYDVYFDY | 902 |
| | VL | SSSVSY | 924 | ATS | 940 | WSSNPP | 948 |
| CD3-4 | VH | GYTFTRY | 923 | NPSRGY | 936 | YYDDHYCLDY | 898 |
| | VL | SSSVSY | 924 | DTS | 937 | WSSNPL | 949 |
| CD3-5 | VH | GYTFTRY | 923 | NPSRGY | 936 | YYDDHYCLDY | 898 |
| | VL | SSSVSY | 924 | DTS | 937 | WSSNPF | 946 |
| CD3-6 | VH | GFKFSGY | 928 | WYDGSK | 941 | QMGYWHFDL | 905 |
| | VL | SQSVSSY | 929 | DAS | 217 | RSNWPPL | 950 |
| CD3-7 | VH | GFTFSTY | 930 | RSKYNNYAT | 942 | HGNFGNSYVSWFA | 951 |
| | VL | STGAVTTSNY | 926 | GTN | 213 | WYSNLW | 947 |
| CD3-8 | VH | GYTFTRY | 923 | NPSRGY | 936 | YYDDHYCLDY | 898 |
| | VL | SSSVSY | 924 | DTS | 937 | WSSNPL | 949 |

TABLE 12C-continued

CD3 Binders - CDR sequences according to Chothia numbering scheme

| Binding Domain | Chain | CDR1 | SEQ ID NO: | CDR2 | SEQ ID NO: | CDR3 | SEQ ID NO: |
|---|---|---|---|---|---|---|---|
| CD3-9 | VH | GFTFNTY | 925 | RSKYNNYAT | 942 | HGNFGNSYVSWFA | 951 |
|  | VL | STGAVTTSNY | 926 | GTN | 213 | WYSNLW | 947 |
| CD3-10 | VH | GFTFNTY | 925 | RSKYNNYA | 938 | HGNFGNSYVSWFAY | 900 |
|  | VL | STGAVTTSNY | 926 | GTN | 213 | WYSNLW | 947 |
| CD3-11 | VH | GFTFNSY | 931 | RSKYNNYA | 938 | HGNFGNSYVSWWAY | 908 |
|  | VL | STGAVTSGNY | 932 | GTK | 943 | WYSNRW | 952 |
| CD3-12 | VH | GFTFNKY | 933 | RSKYNNYA | 938 | HGNFGNSYISYWAY | 910 |
|  | VL | STGAVTSGNY | 932 | GTK | 943 | WYSNRW | 952 |
| CD3-13 | VH | GYTFTRY | 923 | NPSRGY | 936 | YYDDHYCLDY | 898 |
|  | VL | SSSVSY | 924 | DTS | 937 | WSSNPF | 946 |
| CD3-14 | VH | GFTFSTY | 930 | RSKYNNYA | 938 | HGNFGNSYVSWFAY | 900 |
|  | VL | STGAVTTSNY | 926 | GTN | 213 | WYSNLW | 947 |
| CD3-15 | VH | GFTFNTY | 925 | RSKYNNYA | 938 | HGNFGNSYVSWFAY | 900 |
|  | VL | STGAVTTSNY | 926 | GTN | 213 | WYSNLW | 947 |
| CD3-16 | VH | GFTFNTY | 925 | RSKYNNYA | 938 | HGNFGNSYVSWFAY | 900 |
|  | VL | STGAVTTSNY | 926 | GTN | 213 | WYSNLW | 947 |
| CD3-17 | VH | GFTFSTY | 930 | RSKYNNYA | 938 | HGNFGDSYVSWFAY | 911 |
|  | VL | STGAVTTSNY | 926 | GTN | 213 | WYSNHW | 953 |
| CD3-18 | VH | GYTFTRY | 923 | NPSRGY | 936 | YYDDHYCLDY | 898 |
|  | VL | SSSVSY | 924 | DTS | 937 | WSSNPF | 946 |
| CD3-19 | VH | GYTFTRY | 923 | NPSRGY | 936 | YYDDHYSLDY | 913 |
|  | VL | SSSVSY | 924 | DTS | 937 | WSSNPF | 946 |
| CD3-20 | VH | GYSFTGY | 934 | NPYKGV | 944 | SGYYGDSDWYFDV | 914 |
|  | VL | SQDIRNY | 935 | YTS | 945 | GNTLPW | 954 |
| CD3-21 | VH | GFTFNTY | 925 | RSKYNNYA | 938 | HGNFGNSYVSWFAY | 900 |
|  | VL | RSSTGAVTTSNYAN | 858 | GTNKRAP | 878 | ALWYSNLWV | 901 |

TABLE 12D

CD3 Binders - CDR sequences according to combination of Kabat and Chothia numbering schemes

| Binding Domain | Chain | CDR1 | SEQ ID NO: | CDR2 | SEQ ID NO: | CDR3 | SEQ ID NO: |
|---|---|---|---|---|---|---|---|
| CD3-1 | VH | GYTFTRYTMH | 955 | YINPSRGYTNYNQKFKD | 875 | YYDDHYCLDY | 898 |
|  | VL | SASSSVSYMN | 856 | DTSKLAS | 876 | QQWSSNPFT | 899 |
| CD3-2 | VH | GFTFNTYAMN | 956 | RIRSKYNNYATYYADSVKD | 877 | HGNFGNSYVSWFAY | 900 |
|  | VL | RSSTGAVTTSNYAN | 858 | GTNKRAP | 878 | ALWYSNLWV | 901 |

TABLE 12D-continued

CD3 Binders - CDR sequences according to combination of Kabat and Chothia numbering schemes

| Binding Domain | Chain | CDR1 | SEQ ID NO: | CDR2 | SEQ ID NO: | CDR3 | SEQ ID NO: |
|---|---|---|---|---|---|---|---|
| CD3-3 | VH | GYTFTSYTMH | 957 | YINPSSGYTKYNQKFKD | 879 | WQDYDVYFDY | 902 |
|  | VL | RASSSVSYMH | 860 | ATSNLAS | 880 | QQWSSNPPT | 903 |
| CD3-4 | VH | GYTFTRYTMH | 955 | YINPSRGYTNYNQKFKD | 875 | YYDDHYCLDY | 898 |
|  | VL | RASSSVSYMN | 861 | DTSKVAS | 881 | QQWSSNPLT | 904 |
| CD3-5 | VH | GYTFTRYTMH | 955 | YINPSRGYTNYNQKVKD | 882 | YYDDHYCLDY | 898 |
|  | VL | SASSSVSYMN | 856 | DTSKLAS | 876 | QQWSSNPFT | 899 |
| CD3-6 | VH | GFKFSGYGMH | 958 | VIWYDGSKKYYVDSVKG | 883 | QMGYWHFDL | 905 |
|  | VL | RASQSVSSYLA | 863 | DASNRAT | 158 | QQRSNWPPLT | 906 |
| CD3-7 | VH | GFTFSTYAMN | 959 | RIRSKYNNYATYYADSVK | 963 | HGNFGNSYVSWFAY | 900 |
|  | VL | RSSTGAVTTSNYAN | 858 | GTNKRAP | 878 | ALWYSNLWV | 901 |
| CD3-8 | VH | GYTFTRYTMH | 955 | YINPSRGYTNYNQKFKD | 875 | YYDDHYCLDY | 898 |
|  | VL | RASSSVSYMN | 861 | DTSKVAS | 881 | QQWSSNPLT | 904 |
| CD3-9 | VH | GFTFNTYAMN | 956 | RIRSKYNNYATYYADSVK | 963 | HGNFGNSYVSWFAY | 900 |
|  | VL | RSSTGAVTTSNYAN | 858 | GTNKRAP | 878 | ALWYSNLWV | 901 |
| CD3-10 | VH | GFTFNTYAMN | 956 | RIRSKYNNYATYYADSVKD | 877 | HGNFGNSYVSWFAY | 900 |
|  | VL | RSSTGAVTTSNYAN | 858 | GTNKRAP | 878 | ALWYSNLWV | 901 |
| CD3-11 | VH | GFTFNSYAMN | 960 | RIRSKYNNYATYYADSVKG | 885 | HGNFGNSYVSWWVAY | 908 |
|  | VL | GSSTGAVTSGNYPN | 865 | GTKFLAP | 886 | VLWYSNRWV | 909 |
| CD3-12 | VH | GFTFNKYAMN | 961 | RIRSKYNNYATYYADSVKD | 877 | HGNFGNSYISYWAY | 910 |
|  | VL | GSSTGAVTSGNYPN | 865 | GTKFLAP | 886 | VLWYSNRWV | 909 |
| CD3-13 | VH | GYTFTRYTMH | 955 | YINPSRGYTNYNQKFKD | 875 | YYDDHYCLDY | 898 |
|  | VL | SASSSVSYMN | 856 | DTSKLAS | 876 | QQWSSNPFT | 899 |
| CD3-14 | VH | GFTFSTYAMN | 959 | RIRSKYNNYATYYADSVKD | 877 | HGNFGNSYVSWFAY | 900 |
|  | VL | RSSTGAVTTSNYAN | 858 | GTNKRAP | 878 | ALWYSNLWV | 901 |
| CD3-15 | VH | GFTFNTYAMN | 956 | RIRSKYNNYATYYADSVKD | 877 | HGNFGNSYVSWFAY | 900 |
|  | VL | RSSTGAVTTSNYAN | 858 | GTNKRAP | 878 | ALWYSNLWV | 901 |
| CD3-16 | VH | GFTFNTYAMN | 956 | RIRSKYNNYATYYADSVKG | 885 | HGNFGNSYVSWFAY | 900 |
|  | VL | GSSTGAVTTSNYAN | 867 | GTNKRAP | 878 | ALWYSNLWV | 901 |

TABLE 12D-continued

CD3 Binders - CDR sequences according to combination of Kabat and Chothia numbering schemes

| Binding Domain | Chain | CDR1 | SEQ ID NO: | CDR2 | SEQ ID NO: | CDR3 | SEQ ID NO: |
|---|---|---|---|---|---|---|---|
| CD3-17 | VH | GFTFSTYAMN | 959 | RIRSKYNNYATYYADSVKG | 885 | HGNFGDSYVSWFAY | 911 |
|  | VL | GSSTGAVTTSNYAN | 867 | GTNKRAP | 878 | ALWYSNHWV | 912 |
| CD3-18 | VH | GYTFTRYTMH | 955 | YINPSRGYTNYNQKVKD | 882 | YYDDHYCLDY | 898 |
|  | VL | SASSSVSYMN | 856 | DTSKLAS | 876 | QQWSSNPFT | 899 |
| CD3-19 | VH | GYTFTRYTMH | 955 | YINPSRGYTNYNQKVKD | 882 | YYDDHYSLDY | 913 |
|  | VL | SASSSVSYMN | 856 | DTSKLAS | 876 | QQWSSNPFT | 899 |
| CD3-20 | VH | GYSFTGYTMN | 962 | LINPYKGVSTYNQKFKD | 887 | SGYYGDSDWYFDV | 914 |
|  | VL | RASQDIRNYLN | 869 | YTSRLHS | 964 | QQGNTLPWT | 915 |

In some embodiments, a MBM can comprise a CD3 ABM which comprises the CDRs of any of CD3-1 to CD3-130 as defined by Kabat numbering (e.g., as set forth in Table 12B). In other embodiments, a MBM can comprise a CD3 ABM which comprises the CDRs of any of CD3-1 to CD3-130 as defined by Chothia numbering (e.g., as set forth in Table 12C). In yet other embodiments, a MBM can comprise a CD3 ABM which comprises the CDRs of any of CD3-1 to CD3-130 as defined by a combination of Kabat and Chothia numbering (e.g., as set forth in Table 12D).

In some embodiments, a CD3 ABM comprises the CDR sequences of CD3-1. In some embodiments, a CD3 ABM comprises the CDR sequences of CD3-2. In some embodiments, a CD3 ABM comprises the CDR sequences of CD3-3. In some embodiments, a CD3 ABM comprises the CDR sequences of CD3-4. In some embodiments, a CD3 ABM comprises the CDR sequences of CD3-5. In some embodiments a CD3 ABM comprises the CDR sequences of CD3-6. In some embodiments, a CD3 ABM comprises the CDR sequences of CD3-7. In some embodiments, a CD3 ABM comprises the CDR sequences of CD3-8. In some embodiments, a CD3 ABM comprises the CDR sequences of CD3-9. In some embodiments, a CD3 ABM comprises the CDR sequences of CD3-10. In some embodiments, a CD3 ABM comprises the CDR sequences of CD3-11. In some embodiments, a CD3 ABM comprises the CDR sequences of CD3-12. In some embodiments, a CD3 ABM comprises the CDR sequences of CD3-13. In some embodiments, a CD3 ABM comprises the CDR sequences of CD3-14. In some embodiments, a CD3 ABM comprises the CDR sequences of CD3-15. In some embodiments, a CD3 ABM comprises the CDR sequences of CD3-16. In some embodiments, a CD3 ABM comprises the CDR sequences of CD3-17. In some embodiments, a CD3 ABM comprises the CDR sequences of CD3-18. In some embodiments, a CD3 ABM comprises the CDR sequences of CD3-19. In some embodiments, a CD3 ABM comprises the CDR sequences of CD3-20. In some embodiments, a CD3 ABM comprises the CDR sequences of CD3-21. In some embodiments, a CD3 ABM comprises the CDR sequences of CD3-22. In some embodiments, a CD3 ABM comprises the CDR sequences of CD3-23. In some embodiments, a CD3 ABM comprises the CDR sequences of CD3-24. In some embodiments, a CD3 ABM comprises the CDR sequences of CD3-25. In some embodiments, a CD3 ABM comprises the CDR sequences of CD3-26. In some embodiments, a CD3 ABM comprises the CDR sequences of CD3-27. In some embodiments, a CD3 ABM comprises the CDR sequences of CD3-28. In some embodiments, a CD3 ABM comprises the CDR sequences of CD3-29. In some embodiments, a CD3 ABM comprises the CDR sequences of CD3-30. In some embodiments, a CD3 ABM comprises the CDR sequences of CD3-31. In some embodiments, a CD3 ABM comprises the CDR sequences of CD3-32. In some embodiments, a CD3 ABM comprises the CDR sequences of CD3-33. In some embodiments, a CD3 ABM comprises the CDR sequences of CD3-34. In some embodiments, a CD3 ABM comprises the CDR sequences of CD3-35. In some embodiments, a CD3 ABM comprises the CDR sequences of CD3-36. In some embodiments, a CD3 ABM comprises the CDR sequences of CD3-37. In some embodiments, a CD3 ABM comprises the CDR sequences of CD3-38. In some embodiments, a CD3 ABM comprises the CDR sequences of CD3-39. In some embodiments, a CD3 ABM comprises the CDR sequences of CD3-40. In some embodiments, a CD3 ABM comprises the CDR sequences of CD3-41. In some embodiments, a CD3 ABM comprises the CDR sequences of CD3-42. In some embodiments, a CD3 ABM comprises the CDR sequences of CD3-43. In some embodiments, a CD3 ABM comprises the CDR sequences of CD3-44. In some embodiments, a CD3 ABM comprises the CDR sequences of CD3-45. In some embodiments, a CD3 ABM comprises the CDR sequences of CD3-46. In some embodiments, a CD3 ABM comprises the CDR sequences of CD3-47. In some embodiments, a CD3 ABM comprises the CDR sequences of CD3-48. In some embodiments, a CD3 ABM comprises the CDR sequences of CD3-49. In some embodiments, a CD3 ABM comprises the CDR sequences of CD3-50. In some embodiments, a CD3 ABM comprises the CDR sequences of CD3-51. In some embodiments, a CD3 ABM comprises the CDR sequences of CD3-52. In some embodiments, a CD3 ABM comprises the CDR sequences of CD3-53. In some embodiments, a CD3 ABM comprises the CDR sequences of CD3-54. In some embodiments, a CD3 ABM comprises the CDR sequences of CD3-55. In some embodiments, a CD3 ABM comprises the CDR sequences of CD3-56. In some embodiments, a CD3 ABM comprises the CDR sequences of CD3-57. In some embodiments, a CD3 ABM comprises the CDR sequences of CD3-58. In some embodiments, a CD3 ABM comprises the CDR sequences of CD3-59. In some embodiments, a CD3 ABM comprises the CDR sequences of CD3-60. In some embodiments, a CD3 ABM comprises the CDR sequences of CD3-61. In some embodiments, a CD3 ABM comprises the CDR sequences of CD3-62. In some embodiments, a CD3 ABM comprises the CDR sequences of CD3-63. In some embodiments, a CD3 ABM comprises the CDR sequences of CD3-64. In some embodiments, a CD3 ABM comprises the CDR sequences of CD3-65. In some embodiments, a CD3 ABM comprises the CDR sequences of CD3-66. In some embodiments, a CD3 ABM comprises the CDR sequences of CD3-67. In some embodiments, a CD3 ABM comprises the CDR sequences of CD3-68. In some embodiments, a CD3 ABM comprises the CDR sequences of CD3-69. In some embodiments, a CD3 ABM comprises the CDR sequences of CD3-70. In some embodiments, a CD3 ABM comprises the CDR sequences of CD3-71. In some embodiments, a CD3 ABM comprises the CDR sequences of CD3-72. In some embodiments, a CD3 ABM comprises the CDR sequences of CD3-73. In some embodiments, a CD3 ABM comprises the CDR sequences of CD3-74. In some embodiments, a CD3 ABM comprises the CDR sequences of CD3-75. In some embodiments, a CD3 ABM comprises the CDR sequences of CD3-76. In some embodiments, a CD3 ABM comprises the CDR sequences of CD3-77. In some embodiments, a CD3 ABM comprises the CDR sequences of CD3-78. In some embodiments, a CD3 ABM comprises the CDR sequences of CD3-79. In some embodiments, a CD3 ABM comprises the CDR sequences of CD3-80. In some embodiments, a CD3 ABM comprises the CDR sequences of CD3-81. In some embodiments, a CD3 ABM comprises the CDR sequences of CD3-82. In some embodiments, a CD3 ABM comprises the CDR sequences of CD3-83. In some embodiments, a CD3 ABM comprises the CDR sequences of CD3-84. In some embodiments, a CD3 ABM comprises the CDR sequences of CD3-85. In some embodiments, a CD3 ABM comprises the CDR sequences of CD3-86. In some embodiments, a CD3 ABM comprises the CDR sequences of CD3-87. In some embodiments, a CD3 ABM comprises the CDR sequences of CD3-88. In some embodiments, a CD3 ABM comprises the CDR sequences of CD3-89. In some embodiments, a CD3 ABM comprises the CDR sequences of CD3-90. In some embodiments, a CD3 ABM comprises the CDR sequences of CD3-91. In some embodiments, a CD3 ABM comprises the CDR sequences of CD3-92. In some embodiments, a CD3 ABM comprises the CDR sequences of CD3-93. In some embodiments, a CD3 ABM comprises the CDR sequences of CD3-94. In some embodiments, a CD3 ABM comprises the CDR sequences of CD3-95. In some embodiments, a CD3 ABM comprises the CDR sequences of CD3-96. In some embodiments, a CD3 ABM comprises the CDR sequences of CD3-97. In some embodiments, a CD3 ABM comprises the CDR sequences of CD3-98. In some embodiments, a CD3 ABM comprises the CDR sequences of CD3-99. In some embodiments, a CD3 ABM comprises the CDR sequences of CD3-100. In some embodiments, a CD3 ABM comprises the CDR sequences of CD3-101. In some embodiments, a CD3 ABM comprises the CDR sequences of CD3-102. In some embodiments, a CD3 ABM comprises the CDR sequences of CD3-103. In some embodiments, a CD3 ABM comprises the CDR sequences of CD3-104. In some embodiments, a CD3 ABM comprises the CDR sequences of CD3-105. In some embodiments, a CD3 ABM comprises the CDR sequences of CD3-106. In some embodiments, a CD3 ABM comprises the CDR sequences of CD3-107. In some embodiments, a CD3 ABM comprises the CDR sequences of CD3-108. In some embodiments, a CD3 ABM comprises the CDR sequences of CD3-109. In some embodiments, a CD3 ABM comprises the CDR sequences of CD3-110. In some embodiments, a CD3 ABM comprises the CDR sequences of CD3-111. In some embodiments, a CD3 ABM comprises the CDR sequences of CD3-112. In some embodiments, a CD3 ABM comprises the CDR sequences of CD3-113. In some embodiments, a CD3 ABM comprises the CDR sequences of CD3-114. In some embodiments, a CD3 ABM comprises the CDR sequences of CD3-115. In some embodiments, a CD3 ABM comprises the CDR sequences of CD3-116. In some embodiments, a CD3 ABM comprises the CDR sequences of CD3-117. In some embodiments, a CD3 ABM comprises the CDR sequences of CD3-118. In some embodiments, a CD3 ABM comprises the CDR sequences of CD3-119. In some embodiments, a CD3 ABM comprises the CDR sequences of CD3-120. In some embodiments, a CD3 ABM comprises the CDR sequences of CD3-121. In some embodiments, a CD3 ABM comprises the CDR sequences of CD3-122. In some embodiments, a CD3 ABM comprises the CDR sequences of CD3-123. In some embodiments, a CD3 ABM comprises the CDR sequences of CD3-124. In some embodiments, a CD3 ABM comprises the CDR sequences of CD3-125. In some embodiments, a CD3 ABM comprises the CDR sequences of CD3-126. In some embodiments, a CD3 ABM comprises the CDR sequences of CD3-127. In some embodiments, a CD3 ABM comprises the CDR sequences of CD3-126. In some embodiments, a CD3 ABM comprises the CDR sequences of CD3-127. In some embodiments, a CD3 ABM comprises the CDR sequences of CD3-128. In some embodiments, a CD3 ABM comprises the CDR sequences of CD3-129. In some embodiments, a CD3 ABM comprises the CDR sequences of CD3-130.

A MBM can comprise the complete heavy and light variable sequences of any of CD3-1 to CD3-130. In some embodiments, a MBM comprises a CD3 ABM which comprises the VH and VL sequences of CD3-1. In some embodiments, a MBM comprises a CD3 ABM which comprises the VH and VL sequences of CD3-1. In some embodiments, a MBM comprises a CD3 ABM which comprises the VH and VL sequences of CD3-2. In some embodiments, a MBM comprises a CD3 ABM which comprises the VH and VL sequences of CD3-3. In some embodiments, a MBM comprises a CD3 ABM which comprises the VH and VL sequences of CD3-4. In some embodiments, a MBM comprises a CD3 ABM which comprises the VH and VL sequences of CD3-5. In some embodiments, a MBM comprises a CD3 ABM which comprises the VH and VL sequences of CD3-6. In some embodiments, a MBM comprises a CD3 ABM which comprises the VH and VL sequences of CD3-7. In some embodiments, a MBM comprises a CD3 ABM which comprises the VH and VL sequences of CD3-8. In some embodiments, a MBM comprises a CD3 ABM which comprises the VH and VL sequences of CD3-9. In some embodiments, a MBM comprises a CD3 ABM which comprises the VH and VL sequences of CD3-10. In some embodiments, a MBM comprises a CD3 ABM which comprises the VH and VL sequences of CD3-11. In some embodiments, a MBM comprises a CD3 ABM which comprises the VH and VL sequences of CD3-12. In some embodiments, a MBM comprises a CD3 ABM which comprises the VH and VL sequences of CD3-13. In some embodiments, a MBM comprises a CD3 ABM which comprises the VH and VL sequences of CD3-14. In some embodiments, a MBM comprises a CD3 ABM which comprises the VH and VL sequences of CD3-15. In some embodiments, a MBM comprises a CD3 ABM which comprises the VH and VL sequences of CD3-16. In some embodiments, a MBM comprises a CD3 ABM which comprises the VH and VL sequences of CD3-17. In some embodiments, a MBM comprises a CD3 ABM which comprises the VH and VL sequences of CD3-18. In some embodiments, a MBM comprises a CD3 ABM which comprises the VH and VL sequences of CD3-19. In some embodiments, a MBM comprises a CD3 ABM which comprises the VH and VL sequences of CD3-20. In some embodiments, a MBM comprises a CD3 ABM which comprises the VH and VL sequences of CD3-21. In some embodiments, a MBM comprises a CD3 ABM which comprises the VH and VL sequences of CD3-22. In some embodiments, a MBM comprises a CD3 ABM which comprises the VH and VL sequences of CD3-23. In some embodiments, a MBM comprises a CD3 ABM which comprises the VH and VL sequences of CD3-24. In some embodiments, a MBM comprises a CD3 ABM which comprises the VH and VL sequences of CD3-25. In some embodiments, a MBM comprises a CD3 ABM which comprises the VH and VL sequences of CD3-26. In some embodiments, a MBM comprises a CD3 ABM which comprises the VH and VL sequences of CD3-27. In some embodiments, a MBM comprises a CD3 ABM which comprises the VH and VL sequences of CD3-28. In some embodiments, a MBM comprises a CD3 ABM which comprises the VH and VL sequences of CD3-129. In some embodiments, a MBM comprises a CD3 ABM which comprises the VH and VL sequences of CD3-130.

In addition to the CDR sets described in Tables 12B-12D (i.e., the set of six CDRs for each of CD3-1 to CD3-130), the present disclosure provides variant CDR sets. In one embodiment, a set of 6 CDRs can have 1, 2, 3, 4 or 5 amino acid changes from a CDR set described in Tables 12B-12D, as long as the CD3 ABM is still able to bind to the target antigen, as measured by at least one of a Biacore, surface plasmon resonance (SPR) and/or BLI (biolayer interferometry, e.g., Octet assay) assay.

In addition to the variable heavy and variable light domains disclosed in Table 12A that form an ABM to CD3, the present disclosure provides variant VH and VL domains. In one embodiment, the variant VH and VL domains each can have from 1, 2, 3, 4, 5, 6, 7, 8, 9 or 10 amino acid changes from the VH and VL domain set forth in Table 12A, as long as the ABM is still able to bind to the target antigen, as measured at least one of a Biacore, surface plasmon resonance (SPR) and/or BLI (biolayer interferometry, e.g., Octet assay) assay. In another embodiment, the variant VH and VL are at least 90, 95, 97, 98 or 99% identical to the respective VH or VL disclosed in Table 12A, as long as the ABM is still able to bind to the target antigen, as measured by at least one of a Biacore, surface plasmon resonance (SPR) and/or BLI (biolayer interferometry, e.g., Octet assay) assay.

In some embodiments, a MBM can comprise an ABM which is a CD3 binding molecule as described in WO 2020/052692 or an antigen-binding domain thereof. Table AA to Table AJ-2 (collectively "Table A") list sequences of CD3 binding molecules that can be included in CD3 binding ABMs.

TABLE AA

Consensus Group No. C1 Heavy Chain and Light Chain CDR Consensus Sequences

| CDR | Binder | Sequence | SEQ ID NO: |
|---|---|---|---|
| CDR-H1 | C1-1 | GFX$_1$FX$_2$KX$_3$GMX$_4$ | 1032 |
| CDR-H1 | C1-2 | GFX$_1$FX$_2$KX$_3$G | 1033 |
| CDR-H1 | C1-3 | KX$_3$GMX$_4$ | 1034 |
| CDR-H1 | C1-4 | GFX$_1$FX$_2$KX$_3$ | 1035 |
| CDR-H2 | C1-5 | X$_5$IYYDSSX$_6$MYYADTVKG | 1036 |
| CDR-H2 | C1-6 | YYDSSX$_6$ | 1037 |
| CDR-H2 | C1-7 | IYYDSSX$_6$M | 1038 |
| CDR-H3 | C1-8 | X$_{55}$X$_8$X$_9$DLDFDX$_{10}$ | 1039 |
| CDR-H3 | C1-9 | AX$_7$X$_{55}$X$_8$X$_9$DLDFDX$_{10}$ | 1040 |
| CDR-H3 | C1-10 | AALNSEYD | 1041 |
| CDR-H3 | C1-11 | LNSEYD | 1042 |
| CDR-L1 | C1-12 | RX$_{11}$SQSX$_{12}$X$_{13}$X$_{14}$SX$_{15}$X$_{16}$TTYFN | 1043 |
| CDR-L1 | C1-13 | QSX$_{12}$X$_{13}$X$_{14}$SX$_{15}$TTY | 1044 |
| CDR-L1 | C1-14 | SQSX$_{12}$X$_{13}$X$_{14}$SX$_{15}$X$_{16}$TTY | 1045 |
| CDR-L1 | C1-15 | RX$_{11}$SQSX$_{12}$X$_{13}$X$_{14}$SX$_{15}$X$_{16}$ | 1046 |
| CDR-L1 | C1-16 | SQSX$_{12}$X$_{13}$X$_{14}$S | 1047 |
| CDR-L1 | C1-17 | QSX$_{12}$X$_{13}$X$_{14}$S | 1048 |
| CDR-L2 | C1-18 | X$_{17}$X$_{18}$SX$_{19}$X$_{20}$X$_{21}$X$_{22}$ | 1049 |
| CDR-L2 | C1-19 | X$_{17}$X$_{18}$S | 1050 |
| CDR-L3 | C1-20 | LQX$_{23}$X$_{24}$X$_{25}$X$_{26}$PX$_{27}$T | 1051 |
| CDR-L3 | C1-21 | X$_{23}$X$_{24}$X$_{25}$X$_{26}$PX$_{27}$ | 1052 |
| CDR-L3 | C1-22 | LQX$_{23}$X$_{24}$X$_{25}$ | 1053 |
| CDR-L3 | C1-23 | LQX$_{23}$X$_{24}$X$_{25}$X$_{26}$PX$_{27}$ | 1054 |

$X_1$ is T or A; $X_2$ is S or R; $X_3$ is N, Y, or Q; $X_4$ is H or S; $X_5$ is M or L; $X_6$ is K or R; $X_7$ is S or K; $X_{55}$ is F, Y, or S; $X_8$ is W, Y, S, or T; $X_9$ is W, Y, S, or T; $X_{10}$ is H or Y; $X_{11}$ is S or G; $X_{12}$ is I or L; $X_{13}$ is V or G; $X_{14}$ is R or N; $X_{15}$ is D, E, or L; $X_{16}$ is G, N, or E; $X_{17}$ is R or S; $X_{18}$ is V or T; $X_{19}$ is N or T; $X_{20}$ is R or L; $X_{21}$ is F or E; $X_{22}$ is S or Y; $X_{23}$ is S or Y; $X_{24}$ is S or A; $X_{25}$ is H or T; $X_{26}$ is F or Y; $X_{27}$ is W or Y

TABLE AB

Consensus Group No. C2 Heavy Chain and Light Chain CDR Consensus Sequences

| CDR | Binder | Sequence | SEQ ID NO: |
|---|---|---|---|
| CDR-H1 | C2-1 | GFSLTTYNX$_{28}$H | 1055 |
| CDR-H1 | C2-2 | GFSLTTYN | 1056 |
| CDR-H1 | C2-3 | TYNX$_{28}$H | 1057 |
| CDR-H1 | C2-4 | GFSLTTY | 1058 |

TABLE AB-continued

Consensus Group No. C2 Heavy Chain and Light Chain CDR Consensus Sequences

| CDR | Binder | Sequence | SEQ ID NO: |
|---|---|---|---|
| CDR-H2 | C2-5 | RMRYSGDTSX$_{29}$X$_{30}$X$_{31}$ALX$_{32}$S | 1059 |
| CDR-H2 | C2-6 | RYSGD | 1060 |
| CDR-H2 | C2-7 | MRYSGDT | 1061 |
| CDR-H3 | C2-8 | DPMYIPX$_{35}$YX$_{36}$YGVMNA | 1062 |
| CDR-H3 | C2-9 | X$_{33}$X$_{34}$DPMYIPX$_{35}$YX$_{36}$YGVMNA | 1063 |
| CDR-L1 | C2-10 | KX$_{37}$SQNIX$_{38}$X$_{39}$YLN | 1064 |
| CDR-L1 | C2-11 | SQNIX$_{38}$X$_{39}$Y | 1065 |
| CDR-L1 | C2-12 | QNIX$_{38}$X$_{39}$Y | 1066 |
| CDR-L2 | C2-13 | NTX$_{40}$X$_{41}$LX$_{42}$AGVP | 1067 |
| CDR-L2 | C2-14 | NTX$_{40}$X$_{41}$LX$_{42}$A | 1068 |
| CDR-L2 | C2-15 | NTX$_{40}$ | 1069 |
| CDR-L3 | C2-16 | LQHRSX$_{43}$YT | 1070 |
| CDR-L3 | C2-17 | HRSX$_{43}$Y | 1071 |

X$_{28}$ is V or I; X$_{29}$ is F or Y; X$_{30}$ is N or S; X$_{31}$ is A or S; X$_{32}$ is T or K; X$_{33}$ is T or A; X$_{34}$ is S or R; X$_{35}$ is N or G; X$_{36}$ is S or A; X$_{37}$ is A, T, or S; X$_{38}$ is N or D; X$_{39}$ is N or K; X$_{40}$ is D or N; X$_{41}$ is H or N; X$_{42}$ is Q or E; X$_{43}$ is R, S, or G.

TABLE AC

Consensus Group No. C3 Heavy Chain and Light Chain CDR Consensus Sequences

| CDR | Binder | Sequence | SEQ ID NO: |
|---|---|---|---|
| CDR-H1 | C3-1 | GYTFTSYYIY | 1072 |
| CDR-H1 | C3-2 | GYTFTSYY | 1073 |
| CDR-H1 | C3-3 | SYYIY | 1074 |
| CDR-H1 | C3-4 | GYTFTSY | 927 |
| CDR-H2 | C3-5 | YIYPX$_{44}$X$_{45}$X$_{46}$X$_{47}$IYYSEX$_{48}$FKG | 1075 |
| CDR-H2 | C3-6 | YPX$_{44}$X$_{45}$X$_{46}$X$_{47}$ | 1076 |
| CDR-H2 | C3-7 | IYPX$_{44}$X$_{45}$X$_{46}$X$_{47}$I | 1077 |
| CDR-H3 | C3-8 | X$_{49}$RPX$_{50}$TMMAPLX$_{51}$X$_{52}$ | 1078 |
| CDR-H3 | C3-9 | PX$_{50}$TMMAPLX$_{51}$X$_{52}$ | 1079 |
| CDR-L1 | C3-10 | RSSQSLX$_{53}$YSX$_{54}$GNTYLH | 1080 |
| CDR-L1 | C3-11 | SQSLX$_{53}$YSX$_{54}$GNTY | 1081 |
| CDR-L1 | C3-12 | QSLX$_{53}$YSX$_{54}$GNTY | 1082 |
| CDR-L2 | C3-13 | RVSNRFS | 1083 |
| CDR-L2 | C3-14 | RVS | 1084 |
| CDR-L3 | C3-15 | FQSTHLPYT | 1085 |
| CDR-L3 | C3-16 | STHLPY | 1086 |

X$_{44}$ is G or A; X$_{45}$ is H or N; X$_{46}$ is D or G; X$_{47}$ is A or G; X$_{48}$ is N or K; X$_{49}$ is V or A; X$_{50}$ is N or V; X$_{51}$ is A or V; X$_{52}$ is Y or F; X$_{53}$ is I or V; X$_{54}$ is I or H.

TABLE AD-1

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| NOV292 | KNGMH | 1087 | MIYYDSSKMYYADTVKG | 1093 | FWWDLDFDH | 1100 |
| NOV123 | SYYIY | 1074 | YIYPGHDAIYYSENFKG | 1094 | PNTMMAPLAY | 1101 |
| Sp10b | SYYIY | 1074 | YIYPGHDAIYYSENFKG | 1094 | PNTMMAPLAY | 1101 |
| NOV453 | TYNVH | 1088 | RMRYSGDTSFNAALTS | 1095 | DPMYIPNYSYGVMNA | 1102 |
| NOV229 | TYNVH | 1088 | RMRYSGDTSFNAALTS | 1095 | DPMYIPNYSYGVMNA | 1102 |
| NOV110 | SYYIY | 1074 | YIYPANGGIYYSEKFKG | 1096 | PVTMMAPLVF | 1103 |
| NOV832 | SYYIY | 1074 | YIYPANGGIYYSEKFKG | 1096 | PVTMMAPLVF | 1103 |
| NOV589 | KNGMH | 1087 | MIYYDSSRMYYADTVKG | 1097 | FWWDLDFDY | 1104 |
| NOV580 | TYNIH | 1089 | RMRYSGDTSYSSALKS | 1098 | DPMYIPGYSYGVMNA | 1105 |
| NOV567 | KYGMS | 1090 | LIYYDSSKMNYADTVKG | 1099 | LNSEYD | 1042 |

TABLE AD-1-continued

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| NOV221 | TYNIH | 1089 | RMRYSGDTSYSSALKS | 1098 | DPMYIPGYSYGVMNA | 1105 |
| CD3_sp11a_bkm1 | KNGMH | 1087 | MIYYDSSKMYYADTVKG | 1093 | FWWDLDFDH | 1100 |
| CD3_SP11a_bkm2 | KNGMH | 1087 | MIYYDSSKMYYADTVKG | 1093 | FWWDLDFDH | 1100 |
| CD3_sp11a_hz0 | KNGMH | 1087 | MIYYDSSKMYYADTVKG | 1093 | FWWDLDFDH | 1100 |
| CD3_SP11A_HZ1 | KNGMH | 1087 | MIYYDSSKMYYADTVKG | 1093 | FWWDLDFDH | 1100 |
| CD3_sp11a_sansPTM_hz1 | KQGMH | 1091 | MIYYDSSKMYYADTVKG | 1093 | FWWDLDFDH | 1100 |
| CD3_sp11a_sansPTM_rat | KQGMH | 1091 | MIYYDSSKMYYADTVKG | 1093 | FWWDLDFDH | 1100 |
| CD3_sp11a_VHVL_YY | KNGMH | 1087 | MIYYDSSKMYYADTVKG | 1093 | FYYDLDFDH | 1106 |
| CD3_SP11A_VHVL_SS | KNGMH | 1087 | MIYYDSSKMYYADTVKG | 1093 | FSSDLDFDH | 1107 |
| CD3_SP11A_VHVL_WS | KNGMH | 1087 | MIYYDSSKMYYADTVKG | 1093 | FWSDLDFDH | 1108 |
| CD3_sp11a_VHVL_SW | KNGMH | 1087 | MIYYDSSKMYYADTVKG | 1093 | FSWDLDFDH | 1109 |
| CD3_SP11A_VHVL_TT | KNGMH | 1087 | MIYYDSSKMYYADTVKG | 1093 | FTTDLDFDH | 1110 |
| CD3_SP11A_VHVL_TW | KNGMH | 1087 | MIYYDSSKMYYADTVKG | 1093 | FTWDLDFDH | 1111 |
| CD3_SP11A_VHVL_WT | KNGMH | 1087 | MIYYDSSKMYYADTVKG | 1093 | FWTDLDFDH | 1112 |
| CD3 SP11A VH3_VLK_3 | KNGMH | 1087 | MIYYDSSKMYYADTVKG | 1093 | FWWDLDFDH | 1100 |
| CD3_sp11a_VH1_VK2 | KNQMH | 1092 | MIYYDSSKMYYADTVKG | 1093 | FWWDLDFDH | 1100 |
| CD3_SP11A_VH3_VLK1 | KNGMH | 1087 | MIYYDSSKMYYADTVKG | 1093 | FWWDLDFDH | 1100 |
| CD3_SP11A_VH5_VK2 | KQGMH | 1091 | MIYYDSSKMYYADTVKG | 1093 | FWWDLDFDH | 1100 |
| CD3_sp9aFW1_VL_VH_S56G | TYNVH | 1088 | RMRYSGDTSFNAALTS | 1095 | DPMYIPNYAYGVMNA | 1113 |
| CD3_SP9AFW4_VL_VH_S56G | TYNVH | 1088 | RMRYSGDTSFNAALTS | 1095 | DPMYIPNYAYGVMNA | 1113 |
| CD3_sp9aFW1_VLVH | TYNVH | 1088 | RMRYSGDTSFNAALTS | 1095 | DPMYIPNYAYGVMNA | 1113 |
| CD3_sp9aFW4_VLVH | TYNVH | 1088 | RMRYSGDTSFNAALTS | 1095 | DPMYIPNYAYGVMNA | 1113 |
| CD3_sp9arabtor_VHVL | TYNVH | 1088 | RMRYSGDTSFNAALTS | 1095 | DPMYIPNYAYGVMNA | 1113 |
| CD3_sp9arabtor_VLVH | TYNVH | 1088 | RMRYSGDTSFNAALTS | 1095 | DPMYIPNYAYGVMNA | 1113 |
| CD3_sp11a_VHVL_YY_SANSPTM | KNGMH | 1087 | MIYYDSSKMYYADTVKG | 1093 | FYYDLDFDH | 1106 |

TABLE AD-1-continued

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_YY_SANSPTM_Y | KNGMH | 1087 | MIYYDSSKMYYADTVKG | 1093 | YYYDLDFDH | 1114 |
| CD3_sp11a_VHVL_YY_SANSPTM_S | KNGMH | 1087 | MIYYDSSKMYYADTVKG | 1093 | SYYDLDFDH | 1115 |
| CD3_sp11a_VHVL_YY_Y | KNGMH | 1087 | MIYYDSSKMYYADTVKG | 1093 | YYYDLDFDH | 1114 |
| CD3_sp11a_VHVL_YY_s | KNGMH | 1087 | MIYYDSSKMYYADTVKG | 1093 | SYYDLDFDH | 1115 |
| CD3_sp11a_VHVL_SS_SANSPTM | KNGMH | 1087 | MIYYDSSKMYYADTVKG | 1093 | FSSDLDFDH | 1107 |
| CD3_sp11a_VHVL_SS_SANSPTM_Y | KNGMH | 1087 | MIYYDSSKMYYADTVKG | 1093 | YSSDLDFDH | 1116 |
| CD3_sp11a_VHVL_SS_SANSPTM_S | KNGMH | 1087 | MIYYDSSKMYYADTVKG | 1093 | SSSDLDFDH | 1117 |
| CD3_sp11a_VHVL_SS_Y | KNGMH | 1087 | MIYYDSSKMYYADTVKG | 1093 | YSSDLDFDH | 1116 |
| CD3_sp11a_VHVL_SS_S | KNGMH | 1087 | MIYYDSSKMYYADTVKG | 1093 | SSSDLDFDH | 1117 |
| CD3_sp11a_VHVL_SS_SANSPTM | KNGMH | 1087 | MIYYDSSKMYYADTVKG | 1093 | FSSDLDFDH | 1107 |
| CD3_sp11a_VHVL_WS_SANSPTM_Y | KNGMH | 1087 | MIYYDSSKMYYADTVKG | 1093 | YWSDLDFDH | 1118 |
| CD3_sp11a_VHVL_WS_SANSPTM_S | KNGMH | 1087 | MIYYDSSKMYYADTVKG | 1093 | SWSDLDFDH | 1119 |
| CD3_sp11a_VHVL_WS_Y | KNGMH | 1087 | MIYYDSSKMYYADTVKG | 1093 | YWSDLDFDH | 1118 |
| CD3_sp11a_VHVL_WS_S | KNGMH | 1087 | MIYYDSSKMYYADTVKG | 1093 | SWSDLDFDH | 1119 |
| CD3_sp11a_VHVL_WS_SANSPTM | KNGMH | 1087 | MIYYDSSKMYYADTVKG | 1093 | FWSDLDFDH | 1108 |
| CD3_sp11a_VHVL_SW_SANSPTM_Y | KNGMH | 1087 | MIYYDSSKMYYADTVKG | 1093 | YSWDLDFDH | 1120 |
| CD3_sp11a_VHVL_SW_SANSPTM_S | KNGMH | 1087 | MIYYDSSKMYYADTVKG | 1093 | SSWDLDFDH | 1121 |
| CD3_sp11a_VHVL_SW_Y | KNGMH | 1087 | MIYYDSSKMYYADTVKG | 1093 | YSWDLDFDH | 1120 |
| CD3_sp11a_VHVL_SW_S | KNGMH | 1087 | MIYYDSSKMYYADTVKG | 1093 | SSWDLDFDH | 1121 |
| CD3_sp11a_VHVL_SW_SANSPTM | KNGMH | 1087 | MIYYDSSKMYYADTVKG | 1093 | FSWDLDFDH | 1109 |
| CD3_sp11a_VHVL_TW_SANSPTM_Y | KNGMH | 1087 | MIYYDSSKMYYADTVKG | 1093 | YTWDLDFDH | 1122 |
| CD3_sp11a_VHVL_TW_SANSPTM_S | KNGMH | 1087 | MIYYDSSKMYYADTVKG | 1093 | STWDLDFDH | 1123 |
| CD3_sp11a_VHVL_TW_Y | KNGMH | 1087 | MIYYDSSKMYYADTVKG | 1093 | YTWDLDFDH | 1122 |
| CD3_sp11a_VHVL_TW_S | KNGMH | 1087 | MIYYDSSKMYYADTVKG | 1093 | STWDLDFDH | 1123 |
| CD3_sp11a_VHVL_TW_SANSPTM | KNGMH | 1087 | MIYYDSSKMYYADTVKG | 1093 | FTWDLDFDH | 1111 |

TABLE AD-1-continued

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_TT_SANSPTM_Y | KNGMH | 1087 | MIYYDSSKMYYADTVKG | 1093 | YTTDLDFDH | 1124 |
| CD3_sp11a_VHVL_TT_SANSPTM_S | KNGMH | 1087 | MIYYDSSKMYYADTVKG | 1093 | STTDLDFDH | 1125 |
| CD3_sp11a_VHVL_TT_Y | KNGMH | 1087 | MIYYDSSKMYYADTVKG | 1093 | YTTDLDFDH | 1124 |
| CD3_sp11a_VHVL_TT_S | KNGMH | 1087 | MIYYDSSKMYYADTVKG | 1093 | STTDLDFDH | 1125 |
| CD3_sp11a_VHVL_TT_SANSPTM | KNGMH | 1087 | MIYYDSSKMYYADTVKG | 1093 | FTTDLDFDH | 1110 |
| CD3_SP11AVH3_VLK_3_Y | KNGMH | 1087 | MIYYDSSKMYYADTVKG | 1093 | YWWDLDFDH | 1126 |
| CD3_SP11AVH3_VLK_3_S | KNGMH | 1087 | MIYYDSSKMYYADTVKG | 1093 | SWWDLDFDH | 1127 |
| CD3_SP11AVH3_VLK_3_Y_PTM | KNGMH | 1087 | MIYYDSSKMYYADTVKG | 1093 | YWWDLDFDH | 1126 |
| CD3_SP11AVH3_VLK_3_S_PTM | KNGMH | 1087 | MIYYDSSKMYYADTVKG | 1093 | SWWDLDFDH | 1127 |
| CD3_SP11AVH3_VLK_3_Y_SW | KNGMH | 1087 | MIYYDSSKMYYADTVKG | 1093 | YSWDLDFDH | 1120 |
| CD3_SP11AVH3_VLK_3_S_SW | KNGMH | 1087 | MIYYDSSKMYYADTVKG | 1093 | SSWDLDFDH | 1121 |
| CD3_SP11AVH3_VLK_3_Y_PTM_SW | KNGMH | 1087 | MIYYDSSKMYYADTVKG | 1093 | YSWDLDFDH | 1120 |
| CD3_SP11AVH3_VLK_3_S_SWPTM | KNGMH | 1087 | MIYYDSSKMYYADTVKG | 1093 | SSWDLDFDH | 1121 |
| CD3_SP11AVH3_VLK_SWPTM | NGMH | 1087 | MIYYDSSKMYYADTVKG | 1093 | FSWDLDFDH | 1109 |
| CD3_SP11AVH3_VLK_3_SW | KNGMH | 1087 | MIYYDSSKMYYADTVKG | 1093 | FSWDLDFDH | 1109 |
| CD3_sp11a_VH1_VK2_Y | KNQMH | 1092 | MIYYDSSKMYYADTVKG | 1093 | YWWDLDFDH | 1126 |
| CD3_sp11a_VH1_VK2_S | KNQMH | 1092 | MIYYDSSKMYYADTVKG | 1093 | SWWDLDFDH | 1127 |
| CD3_sp11a_VH1_VK2_Y_PTM | KNQMH | 1092 | MIYYDSSKMYYADTVKG | 1093 | YWWDLDFDH | 1126 |
| CD3_sp11a_VH1_VK2_S_PTM | KNQMH | 1092 | MIYYDSSKMYYADTVKG | 1093 | SWWDLDFDH | 1127 |
| CD3_sp11a_VH1_VK2_Y_SW | KNQMH | 1092 | MIYYDSSKMYYADTVKG | 1093 | YSWDLDFDH | 1120 |
| CD3_sp11a_VH1_VK2_S_SW | KNQMH | 1092 | MIYYDSSKMYYADTVKG | 1093 | SSWDLDFDH | 1121 |
| CD3_sp11a_VH1_VK2_Y_PTM | KNQMH | 1092 | MIYYDSSKMYYADTVKG | 1093 | YSWDLDFDH | 1120 |
| CD3_sp11a_VH1_VK2_S_PTM_SW | KNQMH | 1092 | MIYYDSSKMYYADTVKG | 1093 | SSWDLDFDH | 1121 |
| CD3_sp11a_VH1_VK2_SW | KNQMH | 1092 | MIYYDSSKMYYADTVKG | 1093 | FSWDLDFDH | 1109 |
| CD3_sp11a_VH1_VK2_SW_PTM | KNQMH | 1092 | MIYYDSSKMYYADTVKG | 1093 | FSWDLDFDH | 1109 |

TABLE AD-1-continued

CD3 Binders- Heavy Chain CDR sequences according to Kabat numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11A_VH3_VLK1_Y | KNGMH | 1087 | MIYYDSSKMYYADTVKG | 1093 | YWWDLDFDH | 1126 |
| CD3_SP11A_VH3_VLK1_S | KNGMH | 1087 | MIYYDSSKMYYADTVKG | 1093 | SWWDLDFDH | 1127 |
| CD3_SP11A_VH3_VLK1_Y_PTM | KNGMH | 1087 | MIYYDSSKMYYADTVKG | 1093 | YWWDLDFDH | 1126 |
| CD3_SP11A_VH3_VLK1_S_PTM | KNGMH | 1087 | MIYYDSSKMYYADTVKG | 1093 | SWWDLDFDH | 1127 |
| CD3_SP11A_VH3_VLK1_Y_SW | KNGMH | 1087 | MIYYDSSKMYYADTVKG | 1093 | YSWDLDFDH | 1120 |
| CD3_SP11A_VH3_VLK1_S_SW | KNGMH | 1087 | MIYYDSSKMYYADTVKG | 1093 | SSWDLDFDH | 1121 |
| CD3_SP11A_VH3_VLK1_Y_PTM | KNGMH | 1087 | MIYYDSSKMYYADTVKG | 1093 | YWWDLDFDH | 1126 |
| CD3_SP11A_VH3_VLK1_S_PTM_SW | KNGMH | 1087 | MIYYDSSKMYYADTVKG | 1093 | SSWDLDFDH | 1121 |
| CD3_SP11A_VH3_VLK1PTM_SW | KNGMH | 1087 | MIYYDSSKMYYADTVKG | 1093 | FSWDLDFDH | 1109 |
| CD3_SP11A_VH3_VLK1_SW | KNGMH | 1087 | MIYYDSSKMYYADTVKG | 1093 | FSWDLDFDH | 1109 |
| CD3 SP11A VH5 VK2_Y | KQGMH | 1091 | MIYYDSSKMYYADTVKG | 1093 | YWWDLDFDH | 1126 |
| CD3_SP11A_VH5_VK2_S | KQGMH | 1091 | MIYYDSSKMYYADTVKG | 1093 | SWWDLDFDH | 1127 |
| CD3_SP11A_VH5_VK2_Y_PTM | KQGMH | 1091 | MIYYDSSKMYYADTVKG | 1093 | YWWDLDFDH | 1126 |
| CD3_SP11A_VH5_VK2_S_PTM | KQGMH | 1091 | MIYYDSSKMYYADTVKG | 1093 | SWWDLDFDH | 1127 |
| CD3_SP11A_VH5_VK2_Y_SW | KQGMH | 1091 | MIYYDSSKMYYADTVKG | 1093 | YSWDLDFDH | 1120 |
| CD3_SP11A_VH5_VK2_S_SW | KQGMH | 1091 | MIYYDSSKMYYADTVKG | 1093 | SSWDLDFDH | 1121 |
| CD3_SP11A_VH5_VK2_Y_PTM_SW | KQGMH | 1091 | MIYYDSSKMYYADTVKG | 1093 | YSWDLDFDH | 1120 |
| CD3_SP11A_VH5_VK2_S_PTM_SW | KQGMH | 1091 | MIYYDSSKMYYADTVKG | 1093 | SSWDLDFDH | 1121 |
| CD3_SP11A_VH5_VK2_PTM_SW | KQGMH | 1091 | MIYYDSSKMYYADTVKG | 1093 | FSWDLDFDH | 1109 |
| CD3_SP11A_VH5_VK2_SW | KQGMH | 1091 | MIYYDSSKMYYADTVKG | 1093 | FSWDLDFDH | 1109 |

TABLE AD-2

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| NOV292 | RSSQSLVRSDGTTYFN | 1128 | RVSNRFS | 1083 | LQSSHFPWT | 1139 |
| NOV123 | RSSQSLIYSIGNTYLH | 1129 | RVSNRFS | 1083 | FQSTHLPYT | 1085 |

TABLE AD-2-continued

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| Sp10b | RSSQSLIYSIGNTYLH | 1129 | RVSNRFS | 1083 | FQSTHLPYT | 1085 |
| NOV453 | KASQNINNYLN | 1130 | NTDHLQA | 1136 | LQHRSRYT | 1140 |
| NOV229 | KASQNINNYLN | 1130 | NTDHLQA | 1136 | LQHRSRYT | 1140 |
| NOV110 | RSSQSLVYSHGNTYLH | 1131 | RVSNRFS | 1083 | FQSTHLPYT | 1085 |
| NOV832 | RSSQSLVYSHGNTYLH | 1131 | RVSNRFS | 1083 | FQSTHLPYT | 1085 |
| NOV589 | RSSQSLVRSDGTTYFN | 1128 | RVSNRFS | 1083 | LQSSHFPWT | 1139 |
| NOV580 | KTSQNIDKYLN | 1132 | NTNNLEA | 1137 | LQHRSSYT | 1141 |
| NOV567 | RGSQSIGNSLN | 1133 | STSTLEY | 1138 | LQYATYPYT | 1142 |
| NOV221 | KSSQNIDKYLN | 1134 | NTNNLEA | 1137 | LQHRSGYT | 1143 |
| CD3_sp11a_bkm1 | RSSQSLVRSDGTTYFN | 1128 | RVSNRFS | 1083 | LQSSHFPWT | 1139 |
| CD3_SP11a_bkm2 | RSSQSLVRSDGTTYFN | 1128 | RVSNRFS | 1083 | LQSSHFPWT | 1139 |
| CD3_sp11a_hz0 | RSSQSLVRSDGTTYFN | 1128 | RVSNRFS | 1083 | LQSSHFPWT | 1139 |
| CD3_SP11A_HZ1 | RSSQSLVRSDGTTYFN | 1128 | RVSNRFS | 1083 | LQSSH | 1144 |
| CD3_sp11a_sansPTM_hz1 | RSSQSLVRSEGTTYFN | 1135 | RVSNRFS | 1083 | LQSSHFPWT | 1139 |
| CD3_sp11a_sansPTM_rat | RSSQSLVRSEGTTYFN | 1135 | RVSNRFS | 1083 | LQSSHFPWT | 1139 |
| CD3_sp11a_VHVL_YY | RSSQSLVRSDGTTYFN | 1128 | RVSNRFS | 1083 | LQSSHFPWT | 1139 |
| CD3_SP11A_VHVL_SS | RSSQSLVRSDGTTYFN | 1128 | RVSNRFS | 1083 | LQSSHFPWT | 1139 |
| CD3_SP11A_VHVL_WS | RSSQSLVRSDGTTYFN | 1128 | RVSNRFS | 1083 | LQSSHFPWT | 1139 |
| CD3_sp11a_VHVL_SW | RSSQSLVRSDGTTYFN | 1128 | RVSNRFS | 1083 | LQSSHFPWT | 1139 |
| CD3_SP11A_VHVL_TT | RSSQSLVRSDGTTYFN | 1128 | RVSNRFS | 1083 | LQSSHFPWT | 1139 |
| CD3_SP11A_VHVL_TW | RSSQSLVRSDGTTYFN | 1128 | RVSNRFS | 1083 | LQSSHFPWT | 1139 |
| CD3_SP11A_VHVL_WT | RSSQSLVRSDGTTYFN | 1128 | RVSNRFS | 1083 | LQSSHFPWT | 1139 |
| CD3_SP11A_VH3_VLK_3 | RSSQSLVRSEGTTYFN | 1135 | RVSNRFS | 1083 | LQSSHFPWT | 1139 |
| CD3_sp11a_VH1_VK2 | RSSQSLVRSDGTTYFN | 1128 | RVSNRFS | 1083 | LQSSHFPWT | 1139 |
| CD3_SP11A_VH3_VLK1 | RSSQSLVRSEGTTYFN | 1135 | RVSNRFS | 1083 | LQSSHFPWT | 1139 |

TABLE AD-2-continued

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2 | RSSQSLVRSDGTTYFN | 1128 | RVSNRFS | 1083 | LQSSHFPWT | 1139 |
| CD3_sp9aFW1_VL_VH_S56G | KASQNINNYLN | 1130 | NTDHLQA | 1136 | LQHRSRYT | 1140 |
| CD3_SP9AFW4_VL_VH_S56G | KASQNINNYLN | 1130 | NTDHLQA | 1136 | LQHRSRYT | 1140 |
| CD3_sp9aFW1_VLVH | KASQNINNYLN | 1130 | NTDHLQA | 1136 | LQHRSRYT | 1140 |
| CD3_sp9aFW4_VLVH | KASQNINNYLN | 1130 | NTDHLQA | 1136 | LQHRSRYT | 1140 |
| CD3_sp9arabtor_VHVL | KASQNINNYLN | 1130 | NTDHLQA | 1136 | LQHRSRYT | 1140 |
| CD3_sp9arabtor_VLVH | KASQNINNYLN | 1130 | NTDHLQA | 1136 | LQHRSRYT | 1140 |
| CD3_sp11a_VHVL_YY_SANSPTM | RSSQSLVRSEGTTYFN | 1135 | RVSNRFS | 1083 | LQSSHFPWT | 1139 |
| CD3_sp11a_VHVL_YY_SANSPTM_Y | RSSQSLVRSEGTTYFN | 1135 | RVSNRFS | 1083 | LQSSHFPWT | 1139 |
| CD3_sp11a_VHVL_YY_SANSPTM_S | RSSQSLVRSEGTTYFN | 1135 | RVSNRFS | 1083 | LQSSHFPWT | 1139 |
| CD3_sp11a_VHVL_YY_Y | RSSQSLVRSDGTTYFN | 1128 | RVSNRFS | 1083 | LQSSHFPWT | 1139 |
| CD3_sp11a_VHVL_YY_s | RSSQSLVRSDGTTYFN | 1128 | RVSNRFS | 1083 | LQSSHFPWT | 1139 |
| CD3_sp11a_VHVL_SS_SANSPTM | RSSQSLVRSEGTTYFN | 1135 | RVSNRFS | 1083 | LQSSHFPWT | 1139 |
| CD3_sp11a_VHVL_SS_SANSPTM_Y | RSSQSLVRSEGTTYFN | 1135 | RVSNRFS | 1083 | LQSSHFPWT | 1139 |
| CD3_sp11a_VHVL_SS_SANSPTM_S | RSSQSLVRSEGTTYFN | 1135 | RVSNRFS | 1083 | LQSSHFPWT | 1139 |
| CD3_sp11a_VHVL_SS_Y | RSSQSLVRSDGTTYFN | 1128 | RVSNRFS | 1083 | LQSSHFPWT | 1139 |
| CD3_sp11a_VHVL_SS_S | RSSQSLVRSDGTTYFN | 1128 | RVSNRFS | 1083 | LQSSHFPWT | 1139 |
| CD3_sp11a_VHVL_SS_SANSPTM | RSSQSLVRSEGTTYFN | 1135 | RVSNRFS | 1083 | LQSSHFPWT | 1139 |
| CD3_sp11a_VHVL_WS_SANSPTM_Y | RSSQSLVRSEGTTYFN | 1135 | RVSNRFS | 1083 | LQSSHFPWT | 1139 |
| CD3_sp11a_VHVL_WS_SANSPTM_S | RSSQSLVRSEGTTYFN | 1135 | RVSNRFS | 1083 | LQSSHFPWT | 1139 |
| CD3_sp11a_VHVL_WS_Y | RSSQSLVRSDGTTYFN | 1128 | RVSNRFS | 1083 | LQSSHFPWT | 1139 |
| CD3_sp11a_VHVL_WS_S | RSSQSLVRSDGTTYFN | 1128 | RVSNRFS | 1083 | LQSSHFPWT | 1139 |
| CD3_sp11a_VHVL_WS_SANSPTM | RSSQSLVRSEGTTYFN | 1135 | RVSNRFS | 1083 | LQSSHFPWT | 1139 |
| CD3_sp11a_VHVL_SW_SANSPTM_Y | RSSQSLVRSEGTTYFN | 1135 | RVSNRFS | 1083 | LQSSHFPWT | 1139 |
| CD3_sp11a_VHVL_SW_SANSPTM_S | RSSQSLVRSEGTTYFN | 1135 | RVSNRFS | 1083 | LQSSHFPWT | 1139 |

TABLE AD-2-continued

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_SW_Y | RSSQSLVRSDGTTYFN | 1128 | RVSNRFS | 1083 | LQSSHFPWT | 1139 |
| CD3_sp11a_VHVL_SW_S | RSSQSLVRSDGTTYFN | 1128 | RVSNRFS | 1083 | LQSSHFPWT | 1139 |
| CD3_sp11a_VHVL_SW_SANSPTM | RSSQSLVRSEGTTYFN | 1135 | RVSNRFS | 1083 | LQSSHFPWT | 1139 |
| CD3_sp11a_VHVL_TW_SANSPTM_Y | RSSQSLVRSEGTTYFN | 1135 | RVSNRFS | 1083 | LQSSHFPWT | 1139 |
| CD3_sp11a_VHVL_TW_SANSPTM_S | RSSQSLVRSEGTTYFN | 1135 | RVSNRFS | 1083 | LQSSHFPWT | 1139 |
| CD3_sp11a_VHVL_TW_Y | RSSQSLVRSDGTTYFN | 1128 | RVSNRFS | 1083 | LQSSHFPWT | 1139 |
| CD3_sp11a_VHVL_TW_S | RSSQSLVRSDGTTYFN | 1128 | RVSNRFS | 1083 | LQSSHFPWT | 1139 |
| CD3_sp11a_VHVL_TW_SANSPTM | RSSQSLVRSEGTTYFN | 1135 | RVSNRFS | 1083 | LQSSHFPWT | 1139 |
| CD3_sp11a_VHVL_TT_SANSPTM_Y | RSSQSLVRSEGTTYFN | 1135 | RVSNRFS | 1083 | LQSSHFPWT | 1139 |
| CD3_sp11a_VHVL_TT_SANSPTM_S | RSSQSLVRSEGTTYFN | 1135 | RVSNRFS | 1083 | LQSSHFPWT | 1139 |
| CD3_sp11a_VHVL_TT_Y | RSSQSLVRSDGTTYFN | 1128 | RVSNRFS | 1083 | LQSSHFPWT | 1139 |
| CD3_sp11a_VHVL_TT_S | RSSQSLVRSDGTTYFN | 1128 | RVSNRFS | 1083 | LQSSHFPWT | 1139 |
| CD3_sp11a_VHVL_TT_SANSPTM | RSSQSLVRSEGTTYFN | 1135 | RVSNRFS | 1083 | LQSSHFPWT | 1139 |
| CD3_SP11AVH3_VLK_3_Y | RSSQSLVRSEGTTYFN | 1135 | RVSNRFS | 1083 | LQSSHFPWT | 1139 |
| CD3_SP11AVH3_VLK_3_S | RSSQSLVRSEGTTYFN | 1135 | RVSNRFS | 1083 | LQSSHFPWT | 1139 |
| CD3_SP11AVH3_VLK_3_Y_PTM | RSSQSLVRSDGTTYFN | 1128 | RVSNRFS | 1083 | LQSSHFPWT | 1139 |
| CD3_SP11AVH3_VLK_3_S_PTM | RSSQSLVRSDGTTYFN | 1128 | RVSNRFS | 1083 | LQSSHFPWT | 1139 |
| CD3_SP11AVH3_VLK_3_Y_SW | RSSQSLVRSEGTTYFN | 1135 | RVSNRFS | 1083 | LQSSHFPWT | 1139 |
| CD3_SP11AVH3_VLK_3_S_SW | RSSQSLVRSEGTTYFN | 1135 | RVSNRFS | 1083 | LQSSHFPWT | 1139 |
| CD3_SP11AVH3_VLK_3_Y_PTM_SW | RSSQSLVRSDGTTYFN | 1128 | RVSNRFS | 1083 | LQSSHFPWT | 1139 |
| CD3_SP11AVH3_VLK_3_S_SWPTM | RSSQSLVRSDGTTYFN | 1128 | RVSNRFS | 1083 | LQSSHFPWT | 1139 |
| CD3_SP11AVH3_VLK_SWPTM | RSSQSLVRSDGTTYFN | 1128 | RVSNRFS | 1083 | LQSSHFPWT | 1139 |
| CD3_SP11AVH3_VLK_3_SW | RSSQSLVRSEGTTYFN | 1135 | RVSNRFS | 1083 | LQSSHFPWT | 1139 |
| CD3_sp11a_VH1_VK2_Y | RSSQSLVRSDGTTYFN | 1128 | RVSNRFS | 1083 | LQSSHFPWT | 1139 |
| CD3_sp11a_VH1_VK2_S | RSSQSLVRSDGTTYFN | 1128 | RVSNRFS | 1083 | LQSSHFPWT | 1139 |

TABLE AD-2-continued

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM | RSSQSLVRSEGTTYFN | 1135 | RVSNRFS | 1083 | LQSSHFPWT | 1139 |
| CD3_sp11a_VH1_VK2_Y_SW | RSSQSLVRSDGTTYFN | 1128 | RVSNRFS | 1083 | LQSSHFPWT | 1139 |
| CD3_sp11a_VH1_VK2_S_SW | RSSQSLVRSDGTTYFN | 1128 | RVSNRFS | 1083 | LQSSHFPWT | 1139 |
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM_SW | RSSQSLVRSEGTTYFN | 1135 | RVSNRFS | 1083 | LQSSHFPWT | 1139 |
| CD3_sp11a_VH1_VK2_SW | RSSQSLVRSDGTTYFN | 1128 | RVSNRFS | 1083 | LQSSHFPWT | 1139 |
| CD3_sp11a_VH1_VK2_SW_PTM | RSSQSLVRSEGTTYFN | 1135 | RVSNRFS | 1083 | LQSSHFPWT | 1139 |
| CD3_SP11A_VH3_VLK1_Y | RSSQSLVRSEGTTYFN | 1135 | RVSNRFS | 1083 | LQSSHFPWT | 1139 |
| CD3_SP11A_VH3_VLK1_S | RSSQSLVRSEGTTYFN | 1135 | RVSNRFS | 1083 | LQSSHFPWT | 1139 |
| CD3_SP11A_VH3_VLK1_Y_PTM | RSSQSLVRSDGTTYFN | 1128 | RVSNRFS | 1083 | LQSSHFPWT | 1139 |
| CD3_SP11A_VH3_VLK1_S_PTM | RSSQSLVRSDGTTYFN | 1128 | RVSNRFS | 1083 | LQSSHFPWT | 1139 |
| CD3_SP11A_VH3_VLK1_Y_SW | RSSQSLVRSEGTTYFN | 1135 | RVSNRFS | 1083 | LQSSHFPWT | 1139 |
| CD3_SP11A_VH3_VLK1_S_SW | RSSQSLVRSEGTTYFN | 1135 | RVSNRFS | 1083 | LQSSHFPWT | 1139 |
| CD3_SP11A_VH3_VLK1_Y_PTM | RSSQSLVRSDGTTYFN | 1128 | RVSNRFS | 1083 | LQSSHFPWT | 1139 |
| CD3_SP11A_VH3_VLK1_S_PTM_SW | RSSQSLVRSDGTTYFN | 1128 | RVSNRFS | 1083 | LQSSHFPWT | 1139 |
| CD3_SP11A_VH3_VLK1PTM_SW | RSSQSLVRSDGTTYFN | 1128 | RVSNRFS | 1083 | LQSSHFPWT | 1139 |
| CD3_SP11A_VH3_VLK1_SW | RSSQSLVRSEGTTYFN | 1135 | RVSNRFS | 1083 | LQSSHFPWT | 1139 |
| CD3_SP11A_VH5_VK2_Y | RSSQSLVRSDGTTYFN | 1128 | RVSNRFS | 1083 | LQSSHFPWT | 1139 |
| CD3_SP11A_VH5_VK2_S | RSSQSLVRSDGTTYFN | 1128 | RVSNRFS | 1083 | LQSSHFPWT | 1139 |
| CD3_SP11A_VH5_VK2_Y_PTM | RSSQSLVRSDGTTYFN | 1128 | RVSNRFS | 1083 | LQSSHFPWT | 1139 |
| CD3_SP11A_VH5_VK2_S_PTM | RSSQSLVRSDGTTYFN | 1128 | RVSNRFS | 1083 | LQSSHFPWT | 1139 |
| CD3_SP11A_VH5_VK2_Y_SW | RSSQSLVRSDGTTYFN | 1128 | RVSNRFS | 1083 | LQSSHFPWT | 1139 |
| CD3_SP11A_VH5_VK2_S_SW | RSSQSLVRSDGTTYFN | 1128 | RVSNRFS | 1083 | LQSSHFPWT | 1139 |
| CD3_SP11A_VH5_VK2_Y_PTM_SW | RSSQSLVRSDGTTYFN | 1128 | RVSNRFS | 1083 | LQSSHFPWT | 1139 |

TABLE AD-2-continued

CD3 Binders- Light Chain CDR sequences according to Kabat numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2_S_PTM_SW | RSSQSLVRSDGTTYFN | 1128 | RVSNRFS | 1083 | LQSSHFPWT | 1139 |
| CD3_SP11A_VH5_VK2_PTM_SW | RSSQSLVRSDGTTYFN | 1128 | RVSNRFS | 1083 | LQSSHFPWT | 1139 |
| CD3_SP11A_VH5_VK2_SW | RSSQSLVRSDGTTYFN | 1128 | RVSNRFS | 1083 | LQSSHFPWT | 1139 |

TABLE AE-1

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| NOV292 | GFTFSKN | 1145 | YYDSSK | 1148 | FWWDLDFDH | 1100 |
| NOV123 | GYTFTSY | 927 | YPGHDA | 1149 | PNTMMAPLAY | 1101 |
| Sp10b | GYTFTSY | 927 | YPGHDA | 1149 | PNTMMAPLAY | 1101 |
| NOV453 | GFSLTTY | 1058 | RYSGD | 1060 | DPMYIPNYSYGVMNA | 1102 |
| NOV229 | GFSLTTY | 1058 | RYSGD | 1060 | DPMYIPNYSYGVMNA | 1102 |
| NOV110 | GYTFTSY | 927 | YPANGG | 1150 | PVTMMAPLVF | 1103 |
| NOV832 | GYTFTSY | 927 | YPANGG | 1150 | PVTMMAPLVF | 1103 |
| NOV589 | GFTFSKN | 1145 | YYDSSR | 1151 | FWWDLDFDY | 1104 |
| NOV580 | GFSLTTY | 1058 | RYSGD | 1060 | DPMYIPGYSYGVMNA | 1105 |
| NOV567 | GFAFRKY | 1146 | YYDSSK | 1148 | LNSEYD | 1042 |
| NOV221 | GFSLTTY | 1058 | RYSGD | 1060 | DPMYIPGYSYGVMNA | 1105 |
| CD3_sp11a_bkm1 | GFTFSKN | 1145 | YYDSSK | 1148 | FWWDLDFDH | 1100 |
| CD3_SP11a_bkm2 | GFTFSKN | 1145 | YYDSSK | 1148 | FWWDLDFDH | 1100 |
| CD3_sp11a_hz0 | GFTFSKN | 1145 | YYDSSK | 1148 | FWWDLDFDH | 1100 |
| CD3_SP11A_HZ1 | GFTFSKN | 1145 | YYDSSK | 1148 | FWWDLDFDH | 1100 |
| CD3_sp11a_sansPTM_hz1 | GFTFSKQ | 1147 | YYDSSK | 1148 | FWWDLDFDH | 1100 |
| CD3_sp11a_sansPTM_rat | GFTFSKQ | 1147 | YYDSSK | 1148 | FWWDLDFDH | 1100 |
| CD3_sp11a_VHVL_YY | GFTFSKN | 1145 | YYDSSK | 1148 | FYYDLDFDH | 1106 |
| CD3_SP11A_VHVL_SS | GFTFSKN | 1145 | YYDSSK | 1148 | FSSDLDFDH | 1107 |
| CD3_SP11A_VHVL_WS | GFTFSKN | 1145 | YYDSSK | 1148 | FWSDLDFDH | 1108 |
| CD3_sp11a_VHVL_SW | GFTFSKN | 1145 | YYDSSK | 1148 | FSWDLDFDH | 1109 |
| CD3_SP11A_VHVL_TT | GFTFSKN | 1145 | YYDSSK | 1148 | FTTDLDFDH | 1110 |
| CD3_SP11A_VHVL_TW | GFTFSKN | 1145 | YYDSSK | 1148 | FTWDLDFDH | 1111 |
| CD3_SP11A_VHVL_WT | GFTFSKN | 1145 | YYDSSK | 1148 | FWTDLDFDH | 1112 |
| CD3_SP11A_VH3_VLK_3 | GFTFSKN | 1145 | YYDSSK | 1148 | FWWDLDFDH | 1100 |
| CD3_sp11a_VH1_VK2 | GFTFSKQ | 1147 | YYDSSK | 1148 | FWWDLDFDH | 1100 |

TABLE AE-1-continued

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11A_VH3_VLK1 | GFTFSKN | 1145 | YYDSSK | 1148 | FWWDLDFDH | 1100 |
| CD3_SP11A_VH5_VK2 | GFTFSKQ | 1147 | YYDSSK | 1148 | FWWDLDFDH | 1100 |
| CD3_sp9aFW1_VL_VH_S56G | GFSLTTY | 1058 | RYSGD | 1060 | DPMYIPNYAYGVMNA | 1113 |
| CD3_SP9AFW4_VL_VH_S56G | GFSLTTY | 1058 | RYSGD | 1060 | DPMYIPNYAYGVMNA | 1113 |
| CD3_sp9aFW1_VLVH | GFSLTTY | 1058 | RYSGD | 1060 | DPMYIPNYAYGVMNA | 1113 |
| CD3_sp9aFW4_VLVH | GFSLTTY | 1058 | RYSGD | 1060 | DPMYIPNYAYGVMNA | 1113 |
| CD3_sp9arabtor_VHVL | GFSLTTY | 1058 | RYSGD | 1060 | DPMYIPNYAYGVMNA | 1113 |
| CD3_sp9arabtor_VLVH | GFSLTTY | 1058 | RYSGD | 1060 | DPMYIPNYAYGVMNA | 1113 |
| CD3_sp11a_VHVL_YY_SANSPTM | GFTFSKQ | 1147 | YYDSSK | 1148 | FYYDLDFDH | 1106 |
| CD3_sp11a_VHVL_YY_SANSPTM_Y | GFTFSKQ | 1147 | YYDSSK | 1148 | YYYDLDFDH | 1114 |
| CD3_sp11a_VHVL_YY_SANSPTM_S | GFTFSKQ | 1147 | YYDSSK | 1148 | SYYDLDFDH | 1115 |
| CD3_sp11a_VHVL_YY_Y | GFTFSKN | 1145 | YYDSSK | 1148 | YYYDLDFDH | 1114 |
| CD3_sp11a_VHVL_YY_s | GFTFSKN | 1145 | YYDSSK | 1148 | SYYDLDFDH | 1115 |
| CD3_sp11a_VHVL_SS_SANSPTM | GFTFSKQ | 1147 | YYDSSK | 1148 | FSSDLDFDH | 1107 |
| CD3_sp11a_VHVL_SS_SANSPTM_Y | GFTFSKQ | 1147 | YYDSSK | 1148 | YSSDLDFDH | 1116 |
| CD3_sp11a_VHVL_SS_SANSPTM_S | GFTFSKQ | 1147 | YYDSSK | 1148 | SSSDLDFDH | 1117 |
| CD3_sp11a_VHVL_SS_Y | GFTFSKN | 1145 | YYDSSK | 1148 | YSSDLDFDH | 1116 |
| CD3_sp11a_VHVL_SS_S | GFTFSKN | 1145 | YYDSSK | 1148 | SSSDLDFDH | 1117 |
| CD3_sp11a_VHVL_SS_SANSPTM | GFTFSKQ | 1147 | YYDSSK | 1148 | FSSDLDFDH | 1107 |
| CD3_sp11a_VHVL_WS_SANSPTM_Y | GFTFSKQ | 1147 | YYDSSK | 1148 | YWSDLDFDH | 1118 |
| CD3_sp11a_VHVL_WS_SANSPTM_S | GFTFSKQ | 1147 | YYDSSK | 1148 | SWSDLDFDH | 1119 |
| CD3_sp11a_VHVL_WS_Y | GFTFSKN | 1145 | YYDSSK | 1148 | YWSDLDFDH | 1118 |
| CD3_sp11a_VHVL_WS_S | GFTFSKN | 1145 | YYDSSK | 1148 | SWSDLDFDH | 1119 |
| CD3_sp11a_VHVL_WS_SANSPTM | GFTFSKQ | 1147 | YYDSSK | 1148 | FWSDLDFDH | 1108 |
| CD3_sp11a_VHVL_SW_SANSPTM_Y | GFTFSKQ | 1147 | YYDSSK | 1148 | YSWDLDFDH | 1120 |
| CD3_sp11a_VHVL_SW_SANSPTM_S | GFTFSKQ | 1147 | YYDSSK | 1148 | SSWDLDFDH | 1121 |
| CD3_sp11a_VHVL_SW_Y | GFTFSKN | 1145 | YYDSSK | 1148 | YSWDLDFDH | 1120 |

TABLE AE-1-continued

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_SW_S | GFTFSKN | 1145 | YYDSSK | 1148 | SSWDLDFDH | 1121 |
| CD3_sp11a_VHVL_SW_SANSPTM | GFTFSKQ | 1147 | YYDSSK | 1148 | FSWDLDFDH | 1109 |
| CD3_sp11a_VHVL_TW_SANSPTM_Y | GFTFSKQ | 1147 | YYDSSK | 1148 | YTWDLDFDH | 1122 |
| CD3_sp11a_VHVL_TW_SANSPTM_S | GFTFSKQ | 1147 | YYDSSK | 1148 | STWDLDFDH | 1123 |
| CD3_sp11a_VHVL_TW_Y | GFTFSKN | 1145 | YYDSSK | 1148 | YTWDLDFDH | 1122 |
| CD3_sp11a_VHVL_TW_S | GFTFSKN | 1145 | YYDSSK | 1148 | STWDLDFDH | 1123 |
| CD3_sp11a_VHVL_TW_SANSPTM | GFTFSKQ | 1147 | YYDSSK | 1148 | FTWDLDFDH | 1111 |
| CD3_sp11a_VHVL_TT_SANSPTM_Y | GFTFSKQ | 1147 | YYDSSK | 1148 | YTTDLDFDH | 1124 |
| CD3_sp11a_VHVL_TT_SANSPTM_S | GFTFSKQ | 1147 | YYDSSK | 1148 | STTDLDFDH | 1125 |
| CD3_sp11a_VHVL_TT_Y | GFTFSKN | 1145 | YYDSSK | 1148 | YTTDLDFDH | 1124 |
| CD3_sp11a_VHVL_TT_S | GFTFSKN | 1145 | YYDSSK | 1148 | STTDLDFDH | 1125 |
| CD3_sp11a_VHVL_TT_SANSPTM | GFTFSKQ | 1147 | YYDSSK | 1148 | FTTDLDFDH | 1110 |
| CD3_SP11AVH3_VLK_3_Y | GFTFSKN | 1145 | YYDSSK | 1148 | YWWDLDFDH | 1126 |
| CD3_SP11AVH3_VLK_3_S | GFTFSKN | 1145 | YYDSSK | 1148 | SWWDLDFDH | 1127 |
| CD3_SP11AVH3_VLK_3_Y_PTM | GFTFSKN | 1145 | YYDSSK | 1148 | YWWDLDFDH | 1126 |
| CD3_SP11AVH3_VLK_3_S_PTM | GFTFSKN | 1145 | YYDSSK | 1148 | SWWDLDFDH | 1127 |
| CD3_SP11AVH3_VLK_3_Y_SW | GFTFSKN | 1145 | YYDSSK | 1148 | YSWDLDFDH | 1120 |
| CD3_SP11AVH3_VLK_3_S_SW | GFTFSKN | 1145 | YYDSSK | 1148 | SSWDLDFDH | 1121 |
| CD3_SP11AVH3_VLK_3_Y_PTM_SW | GFTFSKN | 1145 | YYDSSK | 1148 | YSWDLDFDH | 1120 |
| CD3_SP11AVH3_VLK_3_S_SWPTM | GFTFSKN | 1145 | YYDSSK | 1148 | SSWDLDFDH | 1121 |
| CD3_SP11AVH3_VLK_SWPTM | GFTFSKN | 1145 | YYDSSK | 1148 | FSWDLDFDH | 1109 |
| CD3_SP11AVH3_VLK_3_SW | GFTFSKN | 1145 | YYDSSK | 1148 | FSWDLDFDH | 1109 |
| CD3_sp11a_VH1_VK2_Y | GFTFSKQ | 1147 | YYDSSK | 1148 | YWWDLDFDH | 1126 |
| CD3_sp11a_VH1_VK2_S | GFTFSKQ | 1147 | YYDSSK | 1148 | SWWDLDFDH | 1127 |
| CD3_sp11a_VH1_VK2_Y_PTM | GFTFSKN | 1145 | YYDSSK | 1148 | YWWDLDFDH | 1126 |
| CD3_sp11a_VH1_VK2_S_PTM | GFTFSKN | 1145 | YYDSSK | 1148 | SWWDLDFDH | 1127 |
| CD3_sp11a_VH1_VK2_Y_SW | GFTFSKQ | 1147 | YYDSSK | 1148 | YSWDLDFDH | 1120 |

TABLE AE-1-continued

CD3 Binders- Heavy Chain CDR sequences according to Chothia numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VH1_VK2_S_SW | GFTFSKQ | 1147 | YYDSSK | 1148 | SSWDLDFDH | 1121 |
| CD3_sp11a_VH1_VK2_Y_PTM | GFTFSKN | 1145 | YYDSSK | 1148 | YSWDLDFDH | 1120 |
| CD3_sp11a_VH1_VK2_S_PTM_SW | GFTFSKN | 1145 | YYDSSK | 1148 | SSWDLDFDH | 1121 |
| CD3_sp11a_VH1_VK2_SW | GFTFSKQ | 1147 | YYDSSK | 1148 | FSWDLDFDH | 1109 |
| CD3_sp11a_VH1_VK2_SW_PTM | GFTFSKN | 1145 | YYDSSK | 1148 | FSWDLDFDH | 1109 |
| CD3_SP11A_VH3_VLK1_Y | GFTFSKN | 1145 | YYDSSK | 1148 | YWWDLDFDH | 1126 |
| CD3_SP11A_VH3_VLK1_S | GFTFSKN | 1145 | YYDSSK | 1148 | SWWDLDFDH | 1127 |
| CD3_SP11A_VH3_VLK1_Y_PTM | GFTFSKQ | 1147 | YYDSSK | 1148 | YWWDLDFDH | 1126 |
| CD3_SP11A_VH3_VLK1_S_PTM | GFTFSKN | 1145 | YYDSSK | 1148 | SWWDLDFDH | 1127 |
| CD3_SP11A_VH3_VLK1_Y_SW | GFTFSKN | 1145 | YYDSSK | 1148 | YSWDLDFDH | 1120 |
| CD3_SP11A_VH3_VLK1_S_SW | GFTFSKN | 1145 | YYDSSK | 1148 | SSWDLDFDH | 1121 |
| CD3_SP11A_VH3_VLK1_Y_PTM | GFTFSKQ | 1147 | YYDSSK | 1148 | YWWDLDFDH | 1126 |
| CD3_SP11A_VH3_VLK1_S_PTM_SW | GFTFSKN | 1145 | YYDSSK | 1148 | SSWDLDFDH | 1121 |
| CD3_SP11A_VH3_VLK1PTM_SW | GFTFSKN | 1145 | YYDSSK | 1148 | FSWDLDFDH | 1109 |
| CD3_SP11A_VH3_VLK1_SW | GFTFSKN | 1145 | YYDSSK | 1148 | FSWDLDFDH | 1109 |
| CD3_SP11A_VH5_VK2_Y | GFTFSKQ | 1147 | YYDSSK | 1148 | YWWDLDFDH | 1126 |
| CD3_SP11A_VH5_VK2_S | GFTFSKQ | 1147 | YYDSSK | 1148 | SWWDLDFDH | 1127 |
| CD3_SP11A_VH5_VK2_Y_PTM | GFTFSKN | 1145 | YYDSSK | 1148 | YWWDLDFDH | 1126 |
| CD3_SP11A_VH5_VK2_S_PTM | GFTFSKN | 1145 | YYDSSK | 1148 | SWWDLDFDH | 1127 |
| CD3_SP11A_VH5_VK2_Y_SW | GFTFSKQ | 1147 | YYDSSK | 1148 | YSWDLDFDH | 1120 |
| CD3_SP11A_VH5_VK2_S_SW | GFTFSKQ | 1147 | YYDSSK | 1148 | SSWDLDFDH | 1121 |
| CD3_SP11A_VH5_VK2_Y_PTM__SW | GFTFSKN | 1145 | YYDSSK | 1148 | YSWDLDFDH | 1120 |
| CD3_SP11A_VH5_VK2_S_PTM__SW | GFTFSKN | 1145 | YYDSSK | 1148 | SSWDLDFDH | 1121 |
| CD3_SP11A_VH5_VK2_PTM_SW | GFTFSKN | 1145 | YYDSSK | 1148 | FSWDLDFDH | 1109 |
| CD3_SP11A_VH5_VK2_SW | GFTFSKQ | 1147 | YYDSSK | 1148 | FSWDLDFDH | 1109 |

TABLE AE-2

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| NOV292 | SQSLVRSDGTTY | 1152 | RVS | 1084 | SSHFPW | 1162 |
| NOV123 | SQSLIYSIGNTY | 1153 | RVS | 1084 | STHLPY | 1086 |
| Sp10b | SQSLIYSIGNTY | 1153 | RVS | 1084 | STHLPY | 1086 |
| NOV453 | SQNINNY | 1154 | NTD | 1159 | HRSRY | 1163 |
| NOV229 | SQNINNY | 1154 | NTD | 1159 | HRSRY | 1163 |
| NOV110 | SQSLVYSHGNTY | 1155 | RVS | 1084 | STHLPY | 1086 |
| NOV832 | SQSLVYSHGNTY | 1155 | RVS | 1084 | STHLPY | 1086 |
| NOV589 | SQSLVRSDGTTY | 1152 | RVS | 1084 | SSHFPW | 1162 |
| NOV580 | SQNIDKY | 1156 | NTN | 1160 | HRSSY | 1164 |
| NOV567 | SQSIGNS | 1157 | STS | 1161 | YATYPY | 1165 |
| NOV221 | SQNIDKY | 1156 | NTN | 1160 | HRSGY | 1166 |
| CD3_sp11a_bkm1 | SQSLVRSDGTTY | 1152 | RVS | 1084 | SSHFPW | 1162 |
| CD3_SP11a_bkm2 | SQSLVRSDGTTY | 1152 | RVS | 1084 | SSHFPW | 1162 |
| CD3_sp11a_hz0 | SQSLVRSDGTTY | 1152 | RVS | 1084 | SSHFPW | 1162 |
| CD3_SP11A_HZ1 | SQSLVRSDGTTY | 1152 | RVS | 1084 | SSHFPW | 1162 |
| CD3_sp11a_sansPTM_hz1 | SQSLVRSEGTTY | 1158 | RVS | 1084 | SSHFPW | 1162 |
| CD3_sp11a_sansPTM_rat | SQSLVRSEGTTY | 1158 | RVS | 1084 | SSHFPW | 1162 |
| CD3_sp11a_VHVL_YY | SQSLVRSDGTTY | 1152 | RVS | 1084 | SSHFPW | 1162 |
| CD3_SP11A_VHVL_SS | SQSLVRSDGTTY | 1152 | RVS | 1084 | SSHFPW | 1162 |
| CD3_SP11A_VHVL_WS | SQSLVRSDGTTY | 1152 | RVS | 1084 | SSHFPW | 1162 |
| CD3_sp11a_VHVL_SW | SQSLVRSDGTTY | 1152 | RVS | 1084 | SSHFPW | 1162 |
| CD3_SP11A_VHVL_TT | SQSLVRSDGTTY | 1152 | RVS | 1084 | SSHFPW | 1162 |
| CD3_SP11A_VHVL_TW | SQSLVRSDGTTY | 1152 | RVS | 1084 | SSHFPW | 1162 |
| CD3_SP11A_VHVL_WT | SQSLVRSDGTTY | 1152 | RVS | 1084 | SSHFPW | 1162 |
| CD3_SP11A_VH3_VLK_3 | SQSLVRSEGTTY | 1158 | RVS | 1084 | SSHFPW | 1162 |
| CD3_sp11a_VH1_VK2 | SQSLVRSDGTTY | 1152 | RVS | 1084 | SSHFPW | 1162 |
| CD3_SP11A_VH3_VLK1 | SQSLVRSEGTTY | 1158 | RVS | 1084 | SSHFPW | 1162 |

TABLE AE-2-continued

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2 | SQSLVRSDGTTY | 1152 | RVS | 1084 | SSHFPW | 1162 |
| CD3_sp9aFW1_VL_VH_S56G | SQNINNY | 1154 | NTD | 1159 | HRSRY | 1163 |
| CD3_SP9AFW4_VL_VH_S56G | SQNINNY | 1154 | NTD | 1159 | HRSRY | 1163 |
| CD3_sp9aFW1_VLVH | SQNINNY | 1154 | NTD | 1159 | HRSRY | 1163 |
| CD3_sp9aFW4_VLVH | SQNINNY | 1154 | NTD | 1159 | HRSRY | 1163 |
| CD3_sp9arabtor_VHVL | SQNINNY | 1154 | NTD | 1159 | HRSRY | 1163 |
| CD3_sp9arabtor_VLVH | SQNINNY | 1154 | NTD | 1159 | HRSRY | 1163 |
| CD3_sp11a_VHVL_YY_SANSPTM | SQSLVRSEGTTY | 1158 | RVS | 1084 | SSHFPW | 1162 |
| CD3_sp11a_VHVL_YY_SANSPTM_Y | SQSLVRSEGTTY | 1158 | RVS | 1084 | SSHFPW | 1162 |
| CD3_sp11a_VHVL_YY_SANSPTM_S | SQSLVRSEGTTY | 1158 | RVS | 1084 | SSHFPW | 1162 |
| CD3_sp11a_VHVL_YY_Y | SQSLVRSDGTTY | 1152 | RVS | 1084 | SSHFPW | 1162 |
| CD3_sp11a_VHVL_YY_s | SQSLVRSDGTTY | 1152 | RVS | 1084 | SSHFPW | 1162 |
| CD3_sp11a_VHVL_SS_SANSPTM | SQSLVRSEGTTY | 1158 | RVS | 1084 | SSHFPW | 1162 |
| CD3_sp11a_VHVL_SS_SANSPTM_Y | SQSLVRSEGTTY | 1158 | RVS | 1084 | SSHFPW | 1162 |
| CD3_sp11a_VHVL_SS_SANSPTM_S | SQSLVRSEGTTY | 1158 | RVS | 1084 | SSHFPW | 1162 |
| CD3_sp11a_VHVL_SS_Y | SQSLVRSDGTTY | 1152 | RVS | 1084 | SSHFPW | 1162 |
| CD3_sp11a_VHVL_SS_S | SQSLVRSDGTTY | 1152 | RVS | 1084 | SSHFPW | 1162 |
| CD3_sp11a_VHVL_SS_SANSPTM | SQSLVRSEGTTY | 1158 | RVS | 1084 | SSHFPW | 1162 |
| CD3_sp11a_VHVL_WS_SANSPTM_Y | SQSLVRSEGTTY | 1158 | RVS | 1084 | SSHFPW | 1162 |
| CD3_sp11a_VHVL_WS_SANSPTM_S | SQSLVRSEGTTY | 1158 | RVS | 1084 | SSHFPW | 1162 |
| CD3_sp11a_VHVL_WS_Y | SQSLVRSDGTTY | 1152 | RVS | 1084 | SSHFPW | 1162 |
| CD3_sp11a_VHVL_WS_S | SQSLVRSDGTTY | 1152 | RVS | 1084 | SSHFPW | 1162 |
| CD3_sp11a_VHVL_WS_SANSPTM | SQSLVRSEGTTY | 1158 | RVS | 1084 | SSHFPW | 1162 |
| CD3_sp11a_VHVL_SW_SANSPTM_Y | SQSLVRSEGTTY | 1158 | RVS | 1084 | SSHFPW | 1162 |
| CD3_sp11a_VHVL_SW_SANSPTM_S | SQSLVRSEGTTY | 1158 | RVS | 1084 | SSHFPW | 1162 |
| CD3_sp11a_VHVL_SW_Y | SQSLVRSDGTTY | 1152 | RVS | 1084 | SSHFPW | 1162 |

TABLE AE-2-continued

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_SW_S | SQSLVRSDGTTY | 1152 | RVS | 1084 | SSHFPW | 1162 |
| CD3_sp11a_VHVL_SW_SANSPTM | SQSLVRSEGTTY | 1158 | RVS | 1084 | SSHFPW | 1162 |
| CD3_sp11a_VHVL_TW_SANSPTM_Y | SQSLVRSEGTTY | 1158 | RVS | 1084 | SSHFPW | 1162 |
| CD3_sp11a_VHVL_TW_SANSPTM_S | SQSLVRSEGTTY | 1158 | RVS | 1084 | SSHFPW | 1162 |
| CD3_sp11a_VHVL_TW_Y | SQSLVRSDGTTY | 1152 | RVS | 1084 | SSHFPW | 1162 |
| CD3_sp11a_VHVL_TW_S | SQSLVRSDGTTY | 1152 | RVS | 1084 | SSHFPW | 1162 |
| CD3_sp11a_VHVL_TW_SANSPTM | SQSLVRSEGTTY | 1158 | RVS | 1084 | SSHFPW | 1162 |
| CD3_sp11a_VHVL_TT_SANSPTM_Y | SQSLVRSEGTTY | 1158 | RVS | 1084 | SSHFPW | 1162 |
| CD3_sp11a_VHVL_TT_SANSPTM_S | SQSLVRSEGTTY | 1158 | RVS | 1084 | SSHFPW | 1162 |
| CD3_sp11a_VHVL_TT_Y | SQSLVRSDGTTY | 1152 | RVS | 1084 | SSHFPW | 1162 |
| CD3_sp11a_VHVL_TT_S | SQSLVRSDGTTY | 1152 | RVS | 1084 | SSHFPW | 1162 |
| CD3_sp11a_VHVL_TT_SANSPTM | SQSLVRSEGTTY | 1158 | RVS | 1084 | SSHFPW | 1162 |
| CD3_SP11AVH3_VLK_3_Y | SQSLVRSEGTTY | 1158 | RVS | 1084 | SSHFPW | 1162 |
| CD3_SP11AVH3_VLK_3_S | SQSLVRSEGTTY | 1158 | RVS | 1084 | SSHFPW | 1162 |
| CD3_SP11AVH3_VLK_3_Y_PTM | SQSLVRSDGTTY | 1152 | RVS | 1084 | SSHFPW | 1162 |
| CD3_SP11AVH3_VLK_3_S_PTM | SQSLVRSDGTTY | 1152 | RVS | 1084 | SSHFPW | 1162 |
| CD3_SP11AVH3_VLK_3_Y_SW | SQSLVRSEGTTY | 1158 | RVS | 1084 | SSHFPW | 1162 |
| CD3_SP11AVH3_VLK_3_S_SW | SQSLVRSEGTTY | 1158 | RVS | 1084 | SSHFPW | 1162 |
| CD3_SP11AVH3_VLK_3_Y_PTM_SW | SQSLVRSDGTTY | 1152 | RVS | 1084 | SSHFPW | 1162 |
| CD3_SP11AVH3_VLK_3_S_SWPTM | SQSLVRSDGTTY | 1152 | RVS | 1084 | SSHFPW | 1162 |
| CD3_SP11AVH3_VLK_SWPTM | SQSLVRSDGTTY | 1152 | RVS | 1084 | SSHFPW | 1162 |
| CD3_SP11AVH3_VLK_3_SW | SQSLVRSEGTTY | 1158 | RVS | 1084 | SSHFPW | 1162 |
| CD3_sp11a_VH1_VK2_Y | SQSLVRSDGTTY | 1152 | RVS | 1084 | SSHFPW | 1162 |
| CD3_sp11a_VH1_VK2_S | SQSLVRSDGTTY | 1152 | RVS | 1084 | SSHFPW | 1162 |
| CD3_sp11a_VH1_VK2_Y_PTM | SQSLVRSEGTTY | 1158 | RVS | 1084 | SSHFPW | 1162 |

TABLE AE-2-continued

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2_S_PTM | SQSLVRSDGTTY | 1152 | RVS | 1084 | SSHFPW | 1162 |
| CD3_sp11a_VH1_VK2_Y_SW | SQSLVRSDGTTY | 1152 | RVS | 1084 | SSHFPW | 1162 |
| CD3_sp11a_VH1_VK2_S_SW | SQSLVRSDGTTY | 1152 | RVS | 1084 | SSHFPW | 1162 |
| CD3_sp11a_VH1_VK2_Y_PTM | SQSLVRSEGTTY | 1158 | RVS | 1084 | SSHFPW | 1162 |
| CD3_sp11a_VH1_VK2_S_PTM_SW | SQSLVRSDGTTY | 1152 | RVS | 1084 | SSHFPW | 1162 |
| CD3_sp11a_VH1_VK2_SW | SQSLVRSDGTTY | 1152 | RVS | 1084 | SSHFPW | 1162 |
| CD3_sp11a_VH1_VK2_SW_PTM | SQSLVRSEGTTY | 1158 | RVS | 1084 | SSHFPW | 1162 |
| CD3_SP11A_VH3_VLK1_Y | SQSLVRSEGTTY | 1158 | RVS | 1084 | SSHFPW | 1162 |
| CD3_SP11A_VH3_VLK1_S | SQSLVRSEGTTY | 1158 | RVS | 1084 | SSHFPW | 1162 |
| CD3_SP11A_VH3_VLK1_Y_PTM | SQSLVRSDGTTY | 1152 | RVS | 1084 | SSHFPW | 1162 |
| CD3_SP11A_VH3_VLK1_S_PTM | SQSLVRSDGTTY | 1152 | RVS | 1084 | SSHFPW | 1162 |
| CD3_SP11A_VH3_VLK1_Y_SW | SQSLVRSEGTTY | 1158 | RVS | 1084 | SSHFPW | 1162 |
| CD3_SP11A_VH3_VLK1_S_SW | SQSLVRSEGTTY | 1158 | RVS | 1084 | SSHFPW | 1162 |
| CD3_SP11A_VH3_VLK1_Y_PTM | SQSLVRSDGTTY | 1152 | RVS | 1084 | SSHFPW | 1162 |
| CD3_SP11A_VH3_VLK1_S_PTM_SW | SQSLVRSDGTTY | 1152 | RVS | 1084 | SSHFPW | 1162 |
| CD3_SP11A_VH3_VLK1PTM_SW | SQSLVRSDGTTY | 1152 | RVS | 1084 | SSHFPW | 1162 |
| CD3_SP11A_VH3_VLK1__SW | SQSLVRSEGTTY | 1158 | RVS | 1084 | SSHFPW | 1162 |
| CD3_SP11A_VH5_VK2_Y | SQSLVRSDGTTY | 1152 | RVS | 1084 | SSHFPW | 1162 |
| CD3_SP11A_VH5_VK2_S | SQSLVRSDGTTY | 1152 | RVS | 1084 | SSHFPW | 1162 |
| CD3_SP11A_VH5_VK2_Y_PTM | SQSLVRSDGTTY | 1152 | RVS | 1084 | SSHFPW | 1162 |
| CD3_SP11A_VH5_VK2_S_PTM | SQSLVRSDGTTY | 1152 | RVS | 1084 | SSHFPW | 1162 |
| CD3_SP11A_VH5_VK2_Y_SW | SQSLVRSDGTTY | 1152 | RVS | 1084 | SSHFPW | 1162 |
| CD3_SP11A_VH5_VK2_S_SW | SQSLVRSDGTTY | 1152 | RVS | 1084 | SSHFPW | 1162 |
| CD3_SP11A_VH5_VK2_Y_PTM_SW | SQSLVRSDGTTY | 1152 | RVS | 1084 | SSHFPW | 1162 |
| CD3_SP11A_VH5_VK2_S_PTM_SW | SQSLVRSDGTTY | 1152 | RVS | 1084 | SSHFPW | 1162 |

TABLE AE-2-continued

CD3 Binders- Light Chain CDR sequences according to Chothia numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2_PTM_SW | SQSLVRSDGTTY | 1152 | RVS | 1084 | SSHFPW | 1162 |
| CD3_SP11A_VH5_VK2_SW | SQSLVRSDGTTY | 1152 | RVS | 1084 | SSHFPW | 1162 |

TABLE AF-1

CD3 Binders- Heavy Chain CDR sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| NOV292 | GFTFSKNG | 1167 | IYYDSSKM | 1170 | ASFWWNDLDFDH | 1174 |
| NOV123 | GYTFTSYY | 1073 | IYPGHDAI | 1171 | VRPNTMMAPLAY | 1175 |
| Sp10b | GYTFTSYY | 1073 | IYPGHDAI | 1171 | VRPNTMMAPLAY | 1175 |
| NOV453 | GFSLTTYN | 1056 | MRYSGDT | 1061 | TSDPMYIPNYSYGVMNA | 1176 |
| NOV229 | GFSLTTYN | 1056 | MRYSGDT | 1061 | ARDPMYIPNYSYGVMNA | 1177 |
| NOV110 | GYTFTSYY | 1073 | IYPANGGI | 1172 | ARPVTMMAPLVF | 1178 |
| NOV832 | GYTFTSYY | 1073 | IYPANGGI | 1172 | ARPVTMMAPLVF | 1178 |
| NOV589 | GFTFSKNG | 1167 | IYYDSSRM | 1173 | ASFWWDLDFDY | 1179 |
| NOV580 | GFSLTTYN | 1056 | MRYSGDT | 1061 | TRDPMYIPGYSYGVMNA | 1180 |
| NOV567 | GFAFRKYG | 1168 | IYYDSSKM | 1170 | AALNSEYD | 1041 |
| NOV221 | GFSLTTYN | 1056 | MRYSGDT | 1061 | TRDPMYIPGYSYGVMNA | 1180 |
| CD3_sp11a_bkm1 | GFTFSKNG | 1167 | IYYDSSKM | 1170 | ASFWWDLDFDH | 1174 |
| CD3_SP11a_bkm2 | GFTFSKNG | 1167 | IYYDSSKM | 1170 | AKFWWDLDFDH | 1181 |
| CD3_sp11a_hz0 | GFTFSKNG | 1167 | IYYDSSKM | 1170 | AKFWWDLDFDH | 1181 |
| CD3_SP11A_HZ1 | GFTFSKNG | 1167 | IYYDSSKM | 1170 | ASFWWDLDFDH | 1174 |
| CD3_sp11a_sansPTM_hz1 | GFTFSKQG | 1169 | IYYDSSKM | 1170 | ASFWWDLDFDH | 1174 |
| CD3_sp11a_sansPTM_rat | GFTFSKQG | 1169 | IYYDSSKM | 1170 | ASFWWDLDFDH | 1174 |
| CD3_sp11a_VHVL_YY | GFTFSKNG | 1167 | IYYDSSKM | 1170 | ASFYYDLDFDH | 1182 |
| CD3_SP11A_VHVL_SS | GFTFSKNG | 1167 | IYYDSSKM | 1170 | ASFSSDLDFDH | 1183 |
| CD3_SP11A_VHVL_WS | GFTFSKNG | 1167 | IYYDSSKM | 1170 | ASFWSDLDFDH | 1184 |

TABLE AF-1-continued

CD3 Binders- Heavy Chain CDR sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_SW | GFTFSKNG | 1167 | IYYDSSKM | 1170 | ASFSWDLDFDH | 1185 |
| CD3_SP11A_VHVL_TT | GFTFSKNG | 1167 | IYYDSSKM | 1170 | ASFTTDLDFDH | 1186 |
| CD3_SP11A_VHVL_TW | GFTFSKNG | 1167 | IYYDSSKM | 1170 | ASFTWDLDFDH | 1187 |
| CD3_SP11A_VHVL_WT | GFTFSKNG | 1167 | IYYDSSKM | 1170 | ASFWTDLDFDH | 1188 |
| CD3_SP11A_VH3_VLK_3 | GFTFSKNG | 1167 | IYYDSSKM | 1170 | ASFWWDLDFDH | 1174 |
| CD3_sp11a_VH1_VK2 | GFTFSKQG | 1169 | IYYDSSKM | 1170 | ASFWWDLDFDH | 1174 |
| CD3_SP11A_VH3_VLK1 | GFTFSKNG | 1167 | IYYDSSKM | 1170 | ASFWWDLDFDH | 1174 |
| CD3_SP11A_VH5_VK2 | GFTFSKQG | 1169 | IYYDSSKM | 1170 | ASFWWDLDFDH | 1174 |
| CD3_sp9aFW1_VL_VH_S56G | GFSLTTYN | 1056 | MRYSGDT | 1061 | ASDPMYIPNYAYGVMNA | 1189 |
| CD3_SP9AFW4_VL_VH_S56G | GFSLTTYN | 1056 | MRYSGDT | 1061 | ASDPMYIPNYAYGVMNA | 1189 |
| CD3_sp9aFW1_VLVH | GFSLTTYN | 1056 | MRYSGDT | 1061 | ASDPMYIPNYAYGVMNA | 1189 |
| CD3_sp9aFW4_VLVH | GFSLTTYN | 1056 | MRYSGDT | 1061 | ASDPMYIPNYAYGVMNA | 1189 |
| CD3_sp9arabtor_VHVL | GFSLTTYN | 1056 | MRYSGDT | 1061 | ASDPMYIPNYAYGVMNA | 1189 |
| CD3_sp9arabtor_VLVH | GFSLTTYN | 1056 | MRYSGDT | 1061 | ASDPMYIPNYAYGVMNA | 1189 |
| CD3_sp11a_VHVL_YY_SANSPTM | GFTFSKQG | 1169 | IYYDSSKM | 1170 | ASFYYDLDFDH | 1182 |
| CD3_sp11a_VHVL_YY_SANSPTM_Y | GFTFSKQG | 1169 | IYYDSSKM | 1170 | ASYYYDLDFDH | 1190 |
| CD3_sp11a_VHVL_YY_SANSPTM_S | GFTFSKQG | 1169 | IYYDSSKM | 1170 | ASSYYDLDFDH | 1191 |
| CD3_sp11a_VHVL_YY_Y | GFTFSKNG | 1167 | IYYDSSKM | 1170 | ASYYYDLDFDH | 1190 |
| CD3_sp11a_VHVL_YY_s | GFTFSKNG | 1167 | IYYDSSKM | 1170 | ASSYYDLDFDH | 1191 |
| CD3_sp11a_VHVL_SS_SANSPTM | GFTFSKQG | 1169 | IYYDSSKM | 1170 | ASFSSDLDFDH | 1183 |
| CD3_sp11a_VHVL_SS_SANSPTM_Y | GFTFSKQG | 1169 | IYYDSSKM | 1170 | ASYSSDLDFDH | 1192 |
| CD3_sp11a_VHVL_SS_SANSPTM_S | GFTFSKQG | 1169 | IYYDSSKM | 1170 | ASSSSDLDFDH | 1193 |
| CD3_sp11a_VHVL_SS_Y | GFTFSKNG | 1167 | IYYDSSKM | 1170 | ASYSSDLDFDH | 1192 |
| CD3_sp11a_VHVL_SS_S | GFTFSKNG | 1167 | IYYDSSKM | 1170 | ASSSSDLDFDH | 1193 |
| CD3_sp11a_VHVL_SS_SANSPTM | GFTFSKQG | 1169 | IYYDSSKM | 1170 | ASFSSDLDFDH | 1183 |

TABLE AF-1-continued

CD3 Binders- Heavy Chain CDR sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_WS SANSPTM_Y | GFTFSKQG | 1169 | IYYDSSKM | 1170 | ASYWSDLDFDH | 1194 |
| CD3_sp11a_VHVL_WS SANSPTM_S | GFTFSKQG | 1169 | IYYDSSKM | 1170 | ASSWSDLDFDH | 1195 |
| CD3_sp11a_VHVL_WS _Y | GFTFSKNG | 1167 | IYYDSSKM | 1170 | ASYWSDLDFDH | 1194 |
| CD3_sp11a_VHVL_WS _S | GFTFSKNG | 1167 | IYYDSSKM | 1170 | ASSWSDLDFDH | 1195 |
| CD3_sp11a_VHVL_WS _SANSPTM | GFTFSKQG | 1169 | IYYDSSKM | 1170 | ASFWSDLDFDH | 1184 |
| CD3_sp11a_VHVL_SW SANSPTM_Y | GFTFSKQG | 1169 | IYYDSSKM | 1170 | ASYSWDLDFDH | 1196 |
| CD3_sp11a_VHVL_SW SANSPTM_S | GFTFSKQG | 1169 | IYYDSSKM | 1170 | ASSSWDLDFDH | 1197 |
| CD3_sp11a_VHVL_SW _Y | GFTFSKNG | 1167 | IYYDSSKM | 1170 | ASYSWDLDFDH | 1196 |
| CD3_sp11a_VHVL_SW _S | GFTFSKNG | 1167 | IYYDSSKM | 1170 | ASSSWDLDFDH | 1197 |
| CD3_sp11a_VHVL_SW _SANSPTM | GFTFSKQG | 1169 | IYYDSSKM | 1170 | ASFSWDLDFDH | 1185 |
| CD3_sp11a_VHVL_TW _SANSPTM_Y | GFTFSKQG | 1169 | IYYDSSKM | 1170 | ASYTWDLDFDH | 1198 |
| CD3_sp11a_VHVL_TW _SANSPTM_S | GFTFSKQG | 1169 | IYYDSSKM | 1170 | ASSTWDLDFDH | 1199 |
| CD3_sp11a_VHVL_TW _Y | GFTFSKNG | 1167 | IYYDSSKM | 1170 | ASYTWDLDFDH | 1198 |
| CD3_sp11a_VHVL_TW _S | GFTFSKNG | 1167 | IYYDSSKM | 1170 | ASSTWDLDFDH | 1199 |
| CD3_sp11a_VHVL_TW _SANSPTM | GFTFSKQG | 1169 | IYYDSSKM | 1170 | ASFTWDLDFDH | 1187 |
| CD3_sp11a_VHVL_TT _SANSPTM_Y | GFTFSKQG | 1169 | IYYDSSKM | 1170 | ASYTTDLDFDH | 1200 |
| CD3_sp11a_VHVL_TT_ SANSPTM_S | GFTFSKQG | 1169 | IYYDSSKM | 1170 | ASSTTDLDFDH | 1201 |
| CD3_sp11a_VHVL_TT_Y | GFTFSKNG | 1167 | IYYDSSKM | 1170 | ASYTTDLDFDH | 1200 |
| CD3_sp11a_VHVL_TT_S | GFTFSKNG | 1167 | IYYDSSKM | 1170 | ASSTTDLDFDH | 1201 |
| CD3_sp11a_VHVL_TT_A SANSPTM | GFTFSKQG | 1169 | IYYDSSKM | 1170 | ASFTTDLDFDH | 1186 |
| CD3_SP11AVH3_VLK_3_ Y | GFTFSKNG | 1167 | IYYDSSKM | 1170 | ASYWWDLDFDH | 1202 |
| CD3_SP11AVH3_VLK_3_ S | GFTFSKNG | 1167 | IYYDSSKM | 1170 | ASSWWDLDFDH | 1203 |
| CD3_SP11AVH3_VLK_3_ Y_PTM | GFTFSKNG | 1167 | IYYDSSKM | 1170 | ASYWWDLDFDH | 1202 |
| CD3_SP11AVH3_VLK_3_ S_PTM | GFTFSKNG | 1167 | IYYDSSKM | 1170 | ASSWWDLDFDH | 1203 |
| CD3_SP11AVH3_VLK_3_ Y_SW | GFTFSKNG | 1167 | IYYDSSKM | 1170 | ASYSWDLDFDH | 1196 |

TABLE AF-1-continued

CD3 Binders- Heavy Chain CDR sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11AVH3_VLK_3_S_SW | GFTFSKNG | 1167 | IYYDSSKM | 1170 | ASSSWDLDFDH | 1197 |
| CD3_SP11AVH3_VLK_3_Y_PTM_SW | GFTFSKNG | 1167 | IYYDSSKM | 1170 | ASYSWDLDFDH | 1196 |
| CD3_SP11AVH3_VLK_3_S_SWPTM | GFTFSKNG | 1167 | IYYDSSKM | 1170 | ASSSWDLDFDH | 1197 |
| CD3_SP11AVH3_VLK_SWPTM | GFTFSKNG | 1167 | IYYDSSKM | 1170 | ASFSWDLDFDH | 1185 |
| CD3_SP11AVH3_VLK_3_SW | GFTFSKNG | 1167 | IYYDSSKM | 1170 | ASFSWDLDFDH | 1185 |
| CD3_sp11a_VH1_VK2_Y | GFTFSKQG | 1169 | IYYDSSKM | 1170 | ASYWWDLDFDH | 1202 |
| CD3_sp11a_VH1_VK2_S | GFTFSKQG | 1169 | IYYDSSKM | 1170 | ASSWWDLDFDH | 1203 |
| CD3_sp11a_VH1_VK2_Y_PTM | GFTFSKNG | 1167 | IYYDSSKM | 1170 | ASYWWDLDFDH | 1202 |
| CD3_sp11a_VH1_VK2_S_PTM | GFTFSKNG | 1167 | IYYDSSKM | 1170 | ASSWWDLDFDH | 1203 |
| CD3_sp11a_VH1_VK2_Y_SW | GFTFSKQG | 1169 | IYYDSSKM | 1170 | ASYSWDLDFDH | 1196 |
| CD3_sp11a_VH1_VK2_S_SW | GFTFSKQG | 1169 | IYYDSSKM | 1170 | ASSSWDLDFDH | 1197 |
| CD3_sp11a_VH1_VK2_Y_PTM | GFTFSKNG | 1167 | IYYDSSKM | 1170 | ASYSWDLDFDH | 1196 |
| CD3_sp11a_VH1_VK2_S_PTM_SW | GFTFSKNG | 1167 | IYYDSSKM | 1170 | ASSSWDLDFDH | 1197 |
| CD3_sp11a_VH1_VK2_SW | GFTFSKQG | 1169 | IYYDSSKM | 1170 | ASFSWDLDFDH | 1185 |
| CD3_sp11a_VH1_VK2_SW_PTM | GFTFSKNG | 1167 | IYYDSSKM | 1170 | ASFSWDLDFDH | 1185 |
| CD3_SP11A_VH3_VLK1_Y | GFTFSKNG | 1167 | IYYDSSKM | 1170 | ASYWWDLDFDH | 1202 |
| CD3_SP11A_VH3_VLK1_S | GFTFSKNG | 1167 | IYYDSSKM | 1170 | ASSWWDLDFDH | 1203 |
| CD3_SP11A_VH3_VLK1_Y_PTM | GFTFSKQG | 1169 | IYYDSSKM | 1170 | ASYWWDLDFDH | 1202 |
| CD3_SP11A_VH3_VLK1_S_PTM | GFTFSKQG | 1169 | IYYDSSKM | 1170 | ASSWWDLDFDH | 1203 |
| CD3_SP11A_VH3_VLK1_Y_SW | GFTFSKNG | 1167 | IYYDSSKM | 1170 | ASYSWDLDFDH | 1196 |
| CD3_SP11A_VH3_VLK1_S_SW | GFTFSKNG | 1167 | IYYDSSKM | 1170 | ASSSWDLDFDH | 1197 |
| CD3_SP11A_VH3_VLK1_Y_PTM | GFTFSKQG | 1169 | IYYDSSKM | 1170 | ASYWWDLDFDH | 1202 |
| CD3_SP11A_VH3_VLK1_S_PTM_SW | GFTFSKQG | 1169 | IYYDSSKM | 1170 | ASSSWDLDFDH | 1197 |
| CD3_SP11A_VH3_VLK1PTM_SW | GFTFSKQG | 1169 | IYYDSSKM | 1170 | ASFSWDLDFDH | 1185 |
| CD3_SP11A_VH3_VLK1_SW | GFTFSKNG | 1167 | IYYDSSKM | 1170 | ASFSWDLDFDH | 1185 |

TABLE AF-1-continued

CD3 Binders- Heavy Chain CDR sequences according to IMGT numbering scheme

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2_Y | GFTFSKQG | 1169 | IYYDSSKM | 1170 | ASYWWDLDFDH | 1202 |
| CD3_SP11A_VI-15_VK2_S | GFTFSKQG | 1169 | IYYDSSKM | 1170 | ASSWWDLDFDH | 1203 |
| CD3_SP11A_VH5_VK2_Y_PTM | GFTFSKNG | 1167 | IYYDSSKM | 1170 | ASYWWDLDFDH | 1202 |
| CD3_SP11A_VH5_VK2_S_PTM | GFTFSKNG | 1167 | IYYDSSKM | 1170 | ASSWWDLDFDH | 1203 |
| CD3_SP11A_VH5_VK2_Y_SW | GFTFSKQG | 1169 | IYYDSSKM | 1170 | ASYSWDLDFDH | 1196 |
| CD3_SP11A_VH5_VK2_S_SW | GFTFSKQG | 1169 | IYYDSSKM | 1170 | ASSSWDLDFDH | 1197 |
| CD3_SP11A_VH5_VK2_Y_PTM_SW | GFTFSKNG | 1167 | IYYDSSKM | 1170 | ASYSWDLDFDH | 1196 |
| CD3_SP11A_VH5_VK2_S_PTM_SW | GFTFSKNG | 1167 | IYYDSSKM | 1170 | ASSSWDLDFDH | 1197 |
| CD3_SP11A_VH5_VK2_PTM_SW | GFTFSKNG | 1167 | IYYDSSKM | 1170 | ASFSWDLDFDH | 1185 |
| CD3_SP11A_VH5_VK2_SW | GFTFSKQG | 1169 | IYYDSSKM | 1170 | ASFSWDLDFDH | 1185 |

TABLE AF-2

CD3 Binders- Chain CDR sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| NOV292 | QSLVRSDGTTY | 1204 | RVS | 1084 | LQSSHFPWT | 1139 |
| NOV123 | QSLIYSIGNTY | 1205 | RVS | 1084 | FQSTHLPYT | 1085 |
| Sp10b | QSLIYSIGNTY | 1205 | RVS | 1084 | FQSTHLPYT | 1085 |
| NOV453 | QNINNY | 1206 | NTDHLQAGVP | 1212 | LQHRSRYT | 1140 |
| NOV229 | QNINNY | 1206 | NTDHLQAGVP | 1212 | LQHRSRYT | 1140 |
| NOV110 | QSLVYSHGNTY | 1207 | RVS | 1084 | FQSTHLPYT | 1085 |
| NOV832 | QSLVYSHGNTY | 1207 | RVS | 1084 | FQSTHLPYT | 1085 |
| NOV589 | QSLVRSDGTTY | 1204 | RVS | 1084 | LQSSHFPWT | 1139 |
| NOV580 | QNIDKY | 1208 | NTNNLEAGVP | 1213 | LQHRSSYT | 1141 |
| NOV567 | QSIGNS | 1209 | STSTLEYGVP | 1214 | LQYATYPYT | 1142 |
| NOV221 | QNIDKY | 1208 | NTNNLEAGVP | 1213 | LQHRSGYT | 1143 |

TABLE AF-2-continued

CD3 Binders- Chain CDR sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_bkm1 | QSLVRSDGTTY | 1204 | RVS | 1084 | LQSSHFPWT | 1139 |
| CD3_SP11a_bkm2 | QSLVRSDGTTY | 1204 | RVS | 1084 | LQSSHFPWT | 1139 |
| CD3_sp11a_hz0 | QSLVRSDGTTY | 1204 | RVS | 1084 | LQSSHFPWT | 1139 |
| CD3_SP11A_HZ1 | QSLVRSDGTTY | 1204 | RVS | 1084 | LQSSH | 1144 |
| CD3_sp11a_sansPTM_hz1 | QSLVRSEGTTY | 1210 | RVS | 1084 | LQSSHFPWT | 1139 |
| CD3_sp11a_sansPTM_rat | QSLVRSEGTTY | 1210 | RVS | 1084 | LQSSHFPWT | 1139 |
| CD3_sp11a_VHVL_YY | QSLVRSDGTTY | 1204 | RVS | 1084 | LQSSHFPWT | 1139 |
| CD3_SP11A_VHVL_SS | QSLVRSDGTTY | 1204 | RVS | 1084 | LQSSHFPWT | 1139 |
| CD3_SP11A_VHVL_WS | QSLVRSDGTTY | 1204 | RVS | 1084 | LQSSHFPWT | 1139 |
| CD3_sp11a_VHVL_SW | QSLVRSDGTTY | 1204 | RVS | 1084 | LQSSHFPWT | 1139 |
| CD3_SP11A_VHVL_TT | QSLVRSDGTTY | 1204 | RVS | 1084 | LQSSHFPWT | 1139 |
| CD3_SP11A_VHVL_TW | QSLVRSDGTTY | 1204 | RVS | 1084 | LQSSHFPWT | 1139 |
| CD3_SP11A_VHVL_WT | QSLVRSDGTTY | 1204 | RVS | 1084 | LQSSHFPWT | 1139 |
| CD3_SP11A_VH3_VLK_3 | QSLVRSEGTTY | 1210 | RVS | 1084 | LQSSHFPWT | 1139 |
| CD3_sp11a_VH1_VK2 | QSLVRSDGTTY | 1204 | RVS | 1084 | LQSSHFPWT | 1139 |
| CD3_SP11A_VH3_VLK1 | QSLVRSEGTTY | 1210 | RVS | 1084 | LQSSHFPWT | 1139 |
| CD3_SP11A_VH5_VK2 | QSLVRSDGTTY | 1204 | RVS | 1084 | LQSSHFPWT | 1139 |
| CD3_sp9aFW1_VL_VH_S56G | QNINNY | 1206 | NTDHLQAGVP | 1212 | LQHRSRYT | 1140 |
| CD3_SP9AFW4_VL_VH_S56G | QNINNY | 1206 | NTDHLQAGVP | 1212 | LQHRSRYT | 1140 |
| CD3_sp9aFW1_VLVH | QNINNY | 1206 | NTDHLQAGVP | 1212 | LQHRSRYT | 1140 |
| CD3_sp9aFW4_VLVH | QNINNY | 1206 | NTDHLQAGVP | 1212 | LQHRSRYT | 1140 |
| CD3_sp9arabtor_VHVL | QNINNY | 1206 | NTDHLQAGVP | 1212 | LQHRSRYT | 1140 |
| CD3_sp9arabtor_VLVH | QNINNY | 1206 | NTDHLQAGVP | 1212 | LQHRSRYT | 1140 |
| CD3_sp11a_VHVL_YY_SANSPTM | QSLVRSEGTTY | 1210 | RVS | 1084 | LQSSHFPWT | 1139 |
| CD3_sp11a_VHVL_YY_SANSPTM_Y | QSLVRSEGTTY | 1210 | RVS | 1084 | LQSSHFPWT | 1139 |

TABLE AF-2-continued

CD3 Binders- Chain CDR sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_YY_SANSPTM_S | QSLVRSEGTTY | 1210 | RVS | 1084 | LQSSHFPWT | 1139 |
| CD3_sp11a_VHVL_YY_Y | QSLVRSDGTTY | 1204 | RVS | 1084 | LQSSHFPWT | 1139 |
| CD3_sp11a_VHVL_YY_s | QSLVRSDGTTY | 1204 | RVS | 1084 | LQSSHFPWT | 1139 |
| CD3_sp11a_VHVL_SS_SANSPTM | QSLVRSEGTTY | 1210 | RVS | 1084 | LQSSHFPWT | 1139 |
| CD3_sp11a_VHVL_SS_SANSPTM_Y | QSLVRSEGTTY | 1210 | RVS | 1084 | LQSSHFPWT | 1139 |
| CD3_sp11a_VHVL_SS_SANSPTM_S | QSLVRSEGTTY | 1210 | RVS | 1084 | LQSSHFPWT | 1139 |
| CD3_sp11a_VHVL_SS_Y | QSLVRSDGTTY | 1204 | RVS | 1084 | LQSSHFPWT | 1139 |
| CD3_sp11a_VHVL_SS_S | QSLVRSDGTTY | 1204 | RVS | 1084 | LQSSHFPWT | 1139 |
| CD3_sp11a_VHVL_SS_SANSPTM | QSLVRSEGTTY | 1210 | RVS | 1084 | LQSSHFPWT | 1139 |
| CD3_sp11a_VHVL_WS_SANSPTM_Y | QSLVRSEGTTY | 1210 | RVS | 1084 | LQSSHFPWT | 1139 |
| CD3_sp11a_VHVL_WS_SANSPTM_S | QSLVRSEGTTY | 1210 | RVS | 1084 | LQSSHFPWT | 1139 |
| CD3_sp11a_VHVL_WS_Y | QSLVRSDGTTY | 1204 | RVS | 1084 | LQSSHFPWT | 1139 |
| CD3_sp11a_VHVL_WS_S | QSLVRSDGTTY | 1204 | RVS | 1084 | LQSSHFPWT | 1139 |
| CD3_sp11a_VHVL_WS_SANSPTM | QSLVRSEGTTY | 1210 | RVS | 1084 | LQSSHFPWT | 1139 |
| CD3_sp11a_VHVL_SW_SANSPTM_Y | QSLVRSEGTTY | 1210 | RVS | 1084 | LQSSHFPWT | 1139 |
| CD3_sp11a_VHVL_SW_SANSPTM_S | QSLVRSEGTTY | 1210 | RVS | 1084 | LQSSHFPWT | 1139 |
| CD3_sp11a_VHVL_SW_Y | QSLVRSDGTTY | 1204 | RVS | 1084 | LQSSHFPWT | 1139 |
| CD3_sp11a_VHVL_SW_S | QSLVRSDGTTY | 1204 | RVS | 1084 | LQSSHFPWT | 1139 |
| CD3_sp11a_VHVL_SW_SANSPTM | QSLVRSEGTTY | 1210 | RVS | 1084 | LQSSHFPWT | 1139 |
| CD3_sp11a_VHVL_TW_SANSPTM_Y | QSLVRSEGTTY | 1210 | RVS | 1084 | LQSSHFPWT | 1139 |
| CD3_sp11a_VHVL_TW_SANSPTM_S | QSLVRSEGTTY | 1210 | RVS | 1084 | LQSSHFPWT | 1139 |
| CD3_sp11a_VHVL_TW_Y | QSLVRSDGTTY | 1204 | RVS | 1084 | LQSSHFPWT | 1139 |
| CD3_sp11a_VHVL_TW_S | QSLVRSDGTTY | 1204 | RVS | 1084 | LQSSHFPWT | 1139 |
| CD3_sp11a_VHVL_TW_SANSPTM | QSLVRSEGTTY | 1210 | RVS | 1084 | LQSSHFPWT | 1139 |
| CD3_sp11a_VHVL_TT_SANSPTM_Y | QSLVRSEGTTY | 1210 | RVS | 1084 | LQSSHFPWT | 1139 |

TABLE AF-2-continued

CD3 Binders- Chain CDR sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_TT_SANSPTM_S | QSLVRSEGTTY | 1210 | RVS | 1084 | LQSHFPWT | 1139 |
| CD3_sp11a_VHVL_TT_Y | QSLVRSDGTTY | 1204 | RVS | 1084 | LQSHFPWT | 1139 |
| CD3_sp11a_VHVL_TT_S | QSLVRSDGTTY | 1204 | RVS | 1084 | LQSSHFPWT | 1139 |
| CD3_sp11a_VHVL_TT_SANSPTM | QSLVRSEGTTY | 1210 | RVS | 1084 | LQSSHFPWT | 1139 |
| CD3_SP11AVH3_VLK_3_Y | QSLVRSEGTTY | 1210 | RVS | 1084 | LQSSHFPWT | 1139 |
| CD3_SP11AVH3_VLK_3_S | QSLVRSEGTTY | 1210 | RVS | 1084 | LQSSHFPWT | 1139 |
| CD3_SP11AVH3_VLK_3_Y_PTM | QSLVRSDGTTY | 1204 | RVS | 1084 | LQSSHFPWT | 1139 |
| CD3_SP11AVH3_VLK_3_S_PTM | QSLVRSDGTTY | 1204 | RVS | 1084 | LQSSHFPWT | 1139 |
| CD3_SP11AVH3_VLK_3_Y_SW | QSLVRSEGTTY | 1210 | RVS | 1084 | LQSSHFPWT | 1139 |
| CD3_SP11AVH3_VLK_3_S_SW | QSLVRSEGTTY | 1210 | RVS | 1084 | LQSSHFPWT | 1139 |
| CD3_SP11AVH3_VLK_3_Y_PTM_SW | QSLVRSDGTTY | 1204 | RVS | 1084 | LQSSHFPWT | 1139 |
| CD3_SP11AVH3_VLK_3_S_SWPTM | QSLVRSDGTTY | 1204 | RVS | 1084 | LQSSHFPWT | 1139 |
| CD3_SP11AVH3_VLK_SWPTM | QSLVRSDGTTY | 1204 | RVS | 1084 | LQSSHFPWT | 1139 |
| CD3_SP11AVH3_VLK_3_SW | QSLVRSEGTTY | 1210 | RVS | 1084 | LQSSHFPWT | 1139 |
| CD3_sp11a_VH1_VK2_Y | QSLVRSDGTTY | 1204 | RVS | 1084 | LQSSHFPWT | 1139 |
| CD3_sp11a_VH1_VK2_S | QSLVRSDGTTY | 1204 | RVS | 1084 | LQSSHFPWT | 1139 |
| CD3_sp11a_VH1_VK2_Y_PTM | QSLVRSEGTTY | 1210 | RVS | 1084 | LQSSHFPWT | 1139 |
| CD3_sp11a_VH1_VK2_S_PTM | QSLVRSEGTTY | 1210 | RVS | 1084 | LQSSHFPWT | 1139 |
| CD3_sp11a_VH1_VK2_Y_SW | QSLVRSDGTTY | 1204 | RVS | 1084 | LQSSHFPWT | 1139 |
| CD3_sp11a_VH1_VK2_S_SW | QSLVRSDGTTY | 1204 | RVS | 1084 | LQSSHFPWT | 1139 |
| CD3_sp11a_VH1_VK2_Y_PTM | QSLVRSEGTTY | 1210 | RVS | 1084 | LQSSHFPWT | 1139 |
| CD3_sp11a_VH1_VK2_S_PTM_SW | QSLVRSEGTTY | 1210 | RVS | 1084 | LQSSHFPWT | 1139 |
| CD3_sp11a_VH1_VK2_SW | QSLVRSDGTTY | 1204 | RVS | 1084 | LQSSHFPWT | 1139 |
| CD3_sp11a_VH1_VK2_SW_PTM | QSLVRSDETTY | 1211 | RVS | 1084 | LQSSHFPWT | 1139 |
| CD3_SP11A_VH3_VLK1_Y | QSLVRSEGTTY | 1210 | RVS | 1084 | LQSSHFPWT | 1139 |

TABLE AF-2-continued

CD3 Binders- Chain CDR sequences according to IMGT numbering scheme

| Binder | CDR-L1 | SEQ ID NO: | CDR-L2 | SEQ ID NO: | CDR-L3 | SEQ ID NO: |
|---|---|---|---|---|---|---|
| CD3_SP11A_VH3_VLK1_S | QSLVRSEGTTY | 1210 | RVS | 1084 | LQSSHFPWT | 1139 |
| CD3_SP11A_VH3_VLK1_Y_PTM | QSLVRSDGTTY | 1204 | RVS | 1084 | LQSSHFPWT | 1139 |
| CD3_SP11A_VH3_VLK1_S_PTM | QSLVRSDGTTY | 1204 | RVS | 1084 | LQSSHFPWT | 1139 |
| CD3_SP11A_VH3_VLK1_Y_SW | QSLVRSEGTTY | 1210 | RVS | 1084 | LQSSHFPWT | 1139 |
| CD3_SP11A_VH3_VLK1_S_SW | QSLVRSEGTTY | 1210 | RVS | 1084 | LQSSHFPWT | 1139 |
| CD3_SP11A_VH3_VLK1_Y_PTM | QSLVRSDGTTY | 1204 | RVS | 1084 | LQSSHFPWT | 1139 |
| CD3_SP11A_VH3_VLK1_S_PTM_SW | QSLVRSDGTTY | 1204 | RVS | 1084 | LQSSHFPWT | 1139 |
| CD3_SP11A_VH3_VLK1PTM_SW | QSLVRSDGTTY | 1204 | RVS | 1084 | LQSSHFPWT | 1139 |
| CD3_SP11A_VH3_VLK1_SW | QSLVRSEGTTY | 1210 | RVS | 1084 | LQSSHFPWT | 1139 |
| CD3_SP11A_VH5_VK2_Y | QSLVRSDGTTY | 1204 | RVS | 1084 | LQSSHFPWT | 1139 |
| CD3_SP11A_VH5_VK2_S | QSLVRSDGTTY | 1204 | RVS | 1084 | LQSSHFPWT | 1139 |
| CD3_SP11A_VH5_VK2_Y_PTM | QSLVRSDGTTY | 1204 | RVS | 1084 | LQSSHFPWT | 1139 |
| CD3_SP11A_VH5_VK2_S_PTM | QSLVRSDGTTY | 1204 | RVS | 1084 | LQSSHFPWT | 1139 |
| CD3_SP11A_VH5_VK2_Y_SW | QSLVRSDGTTY | 1204 | RVS | 1084 | LQSSHFPWT | 1139 |
| CD3_SP11A_VH5_VK2_S_SW | QSLVRSDGTTY | 1204 | RVS | 1084 | LQSSHFPWT | 1139 |
| CD3_SP11A_VH5_VK2_Y_PTM_SW | QSLVRSDGTTY | 1204 | RVS | 1084 | LQSSHFPWT | 1139 |
| CD3_SP11A_VH5_VK2_S_PTM_SW | QSLVRSDGTTY | 1204 | RVS | 1084 | LQSSHFPWT | 1139 |
| CD3_SP11A_VH5_VK2_PTM_SW | QSLVRSDGTTY | 1204 | RVS | 1084 | LQSSHFPWT | 1139 |
| CD3_SP11A_VH5_VK2_SW | QSLVRSDGTTY | 1204 | RVS | 1084 | LQSSHFPWT | 1139 |

TABLE AG-1

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| NOV292 | GFTFSKNGMH | 1215 | MIYYDSSKMYYADTVKG | 1093 | FWWDLDFDH | 1100 |
| NOV123 | GYTFTSYYIY | 1072 | YIYPGHDAIYYSENFKG | 1094 | PNTMMAPLAY | 1101 |

TABLE AG-1-continued

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| Sp10b | GYTFTSYYIY | 1072 | YIYPGHDAIYYSENFKG | 1094 | PNTMMAPLAY | 1101 |
| NOV453 | GFSLTTYNVH | 1216 | RMRYSGDTSFNAALTS | 1095 | DPMYIPNYSYGVMNA | 1102 |
| NOV229 | GFSLTTYNVH | 1216 | RMRYSGDTSFNAALTS | 1095 | DPMYIPNYSYGVMNA | 1102 |
| NOV110 | GYTFTSYYIY | 1072 | YIYPANGGIYYSEKFKG | 1096 | PVTMMAPLVF | 1103 |
| NOV832 | GYTFTSYYIY | 1072 | YIYPANGGIYYSEKFKG | 1096 | PVTMMAPLVF | 1103 |
| NOV589 | GFTFSKNGMH | 1215 | MIYYDSSRMYYADTVKG | 1097 | FWWDLDFDY | 1104 |
| NOV580 | GFSLTTYNIH | 1217 | RMRYSGDTSYSSALKS | 1098 | DPMYIPGYSYGVMNA | 1105 |
| NOV567 | GFAFRKYGMS | 1218 | LIYYDSSKMNYADTVKG | 1099 | LNSEYD | 1042 |
| NOV221 | GFSLTTYNIH | 1217 | RMRYSGDTSYSSALKS | 1098 | DPMYIPGYSYGVMNA | 1105 |
| CD3_sp11a_bkm1 | GFTFSKNGMH | 1215 | MIYYDSSKMYYADTVKG | 1093 | FWWDLDFDH | 1100 |
| CD3_SP11a_bkm2 | GFTFSKNGMH | 1215 | MIYYDSSKMYYADTVKG | 1093 | FWWDLDFDH | 1100 |
| CD3_sp11a_hz0 | GFTFSKNGMH | 1215 | MIYYDSSKMYYADTVKG | 1093 | FWWDLDFDH | 1100 |
| CD3_SP11A_HZ1 | GFTFSKNGMH | 1215 | MIYYDSSKMYYADTVKG | 1093 | FWWDLDFDH | 1100 |
| CD3_sp11a_sansPTM_hz1 | GFTFSKQGMH | 1219 | MIYYDSSKMYYADTVKG | 1093 | FWWDLDFDH | 1100 |
| CD3_sp11a_sansPTM_rat | GFTFSKQGMH | 1219 | MIYYDSSKMYYADTVKG | 1093 | FWWDLDFDH | 1100 |
| CD3_sp11a_VHVL_YY | GFTFSKNGMH | 1215 | MIYYDSSKMYYADTVKG | 1093 | FYYDLDFDH | 1106 |
| CD3_SP11A_VHVL_SS | GFTFSKNGMH | 1215 | MIYYDSSKMYYADTVKG | 1093 | FSSDLDFDH | 1107 |
| CD3_SP11A_VHVL_WS | GFTFSKNGMH | 1215 | MIYYDSSKMYYADTVKG | 1093 | FWSDLDFDH | 1108 |
| CD3_sp11a_VHVL_SW | GFTFSKNGMH | 1215 | MIYYDSSKMYYADTVKG | 1093 | FSWDLDFDH | 1109 |
| CD3_SP11A_VHVL_TT | GFTFSKNGMH | 1215 | MIYYDSSKMYYADTVKG | 1093 | FTTDLDFDH | 1110 |
| CD3_SP11A_VHVL_TW | GFTFSKNGMH | 1215 | MIYYDSSKMYYADTVKG | 1093 | FTWDLDFDH | 1111 |
| CD3_SP11A_VHVL_WT | GFTFSKNGMH | 1215 | MIYYDSSKMYYADTVKG | 1093 | FWTDLDFDH | 1112 |
| CD3_SP11A VH3_VLK_3 | GFTFSKNGMH | 1215 | MIYYDSSKMYYADTVKG | 1093 | FWWDLDFDH | 1100 |
| CD3_sp11a_VH1_VK2 | GFTFSKQGMH | 1219 | MIYYDSSKMYYADTVKG | 1093 | FWWDLDFDH | 1100 |
| CD3_SP11A_VH3_VLK1 | GFTFSKNGMH | 1215 | MIYYDSSKMYYADTVKG | 1093 | FWWDLDFDH | 1100 |

TABLE AG-1-continued

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2 | GFTFSK QGMH | 1219 | MIYYDSSKMY YADTVKG | 1093 | FWWDLDFD H | 1100 |
| CD3_sp9aFW1_VL_VH_ S56G | GFSLTT YNVH | 1216 | RMRYSGDTSF NAALTS | 1095 | DPMYIPNYA YGVMNA | 1113 |
| CD3_SP9AFW4_VL_VH _S56G | GFSLTT YNVH | 1216 | RMRYSGDTSF NAALTS | 1095 | DPMYIPNYA YGVMNA | 1113 |
| CD3_sp9aFW1_VLVH | GFSLTT YNVH | 1216 | RMRYSGDTSF NAALTS | 1095 | DPMYIPNYA YGVMNA | 1113 |
| CD3_sp9aFW4_VLVH | GFSLTT YNVH | 1216 | RMRYSGDTSF NAALTS | 1095 | DPMYIPNYA YGVMNA | 1113 |
| CD3_sp9arabtor_VHVL | GFSLTT YNVH | 1216 | RMRYSGDTSF NAALTS | 1095 | DPMYIPNYA YGVMNA | 1113 |
| CD3_sp9arabtor_VLVH | GFSLTT YNVH | 1216 | RMRYSGDTSF NAALTS | 1095 | DPMYIPNYA YGVMNA | 1113 |
| CD3_sp11a_VHVL_YY_ SANSPTM | GFTFSK QGMH | 1219 | MIYYDSSKMY YADTVKG | 1093 | FWWDLDFD H | 1100 |
| CD3_sp11a_VHVL_YY_ SANSPTM_Y | GFTFSK QGMH | 1219 | MIYYDSSKMY YADTVKG | 1093 | FWWDLDFD H | 1100 |
| CD3_sp11a_VHVL_YY_ SANSPTM_S | GFTFSK QGMH | 1219 | MIYYDSSKMY YADTVKG | 1093 | FWWDLDFD H | 1100 |
| CD3_sp11a_VHVL_YY_ Y | GFTFSK NGMH | 1215 | MIYYDSSKMY YADTVKG | 1093 | FWWDLDFD H | 1100 |
| CD3_sp11a_VHVL_YY_ S | GFTFSK NGMH | 1215 | MIYYDSSKMY YADTVKG | 1093 | FWWDLDFD H | 1100 |
| CD3_sp11a_VHVL_SS_ SANSPTM | GFTFSK QGMH | 1219 | MIYYDSSKMY YADTVKG | 1093 | FWWDLDFD H | 1100 |
| CD3_sp11a_VHVL_SS_ SANSPTM_Y | GFTFSK QGMH | 1219 | MIYYDSSKMY YADTVKG | 1093 | FWWDLDFD H | 1100 |
| CD3_sp11a_VHVL_SS_ SANSPTM_S | GFTFSK QGMH | 1219 | MIYYDSSKMY YADTVKG | 1093 | FWWDLDFD H | 1100 |
| CD3_sp11a_VHVL_SS_ Y | GFTFSK NGMH | 1215 | MIYYDSSKMY YADTVKG | 1093 | FWWDLDFD H | 1100 |
| CD3_sp11a_VHVL_SS_ S | GFTFSK NGMH | 1215 | MIYYDSSKMY YADTVKG | 1093 | FWWDLDFD H | 1100 |
| CD3_sp11a_VHVL_SS _SANSPTM | GFTFSK QGMH | 1219 | MIYYDSSKMY YADTVKG | 1093 | FWWDLDFD H | 1100 |
| CD3_sp11a_VHVL_WS _SANSPTM_Y | GFTFSK QGMH | 1219 | MIYYDSSKMY YADTVKG | 1093 | FWWDLDFD H | 1100 |
| CD3_sp11a_VHVL_WS _SANSPTM_S | GFTFSK QGMH | 1219 | MIYYDSSKMY YADTVKG | 1093 | FWWDLDFD H | 1100 |
| CD3_sp11a_VHVL_WS _Y | GFTFSK NGMH | 1215 | MIYYDSSKMY YADTVKG | 1093 | FWWDLDFD H | 1100 |
| CD3_sp11a_VHVL_WS _S | GFTFSK NGMH | 1215 | MIYYDSSKMY YADTVKG | 1093 | FWWDLDFD H | 1100 |
| CD3_sp11a_VHVL_WS _SANSPTM | GFTFSK QGMH | 1219 | MIYYDSSKMY YADTVKG | 1093 | FWWDLDFD H | 1100 |
| CD3_sp11a_VHVL_SW _SANSPTM_Y | GFTFSK QGMH | 1219 | MIYYDSSKMY YADTVKG | 1093 | FWWDLDFD H | 1100 |

TABLE AG-1-continued

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VHVL_SW_SANSPTM_S | GFTFSKQGMH | 1219 | MIYYDSSKMYYADTVKG | 1093 | FWWDLDFDH | 1100 |
| CD3_sp11a_VHVL_SW_Y | GFTFSKNGMH | 1215 | MIYYDSSKMYYADTVKG | 1093 | FWWDLDFDH | 1100 |
| CD3_sp11a_VHVL_SW_S | GFTFSKNGMH | 1215 | MIYYDSSKMYYADTVKG | 1093 | FWWDLDFDH | 1100 |
| CD3_sp11a_VHVL_SW_SANSPTM | GFTFSKQGMH | 1219 | MIYYDSSKMYYADTVKG | 1093 | FWWDLDFDH | 1100 |
| CD3_sp11a_VHVL_TW_SANSPTM_Y | GFTFSKQGMH | 1219 | MIYYDSSKMYYADTVKG | 1093 | FWWDLDFDH | 1100 |
| CD3_sp11a_VHVL_TW_SANSPTM_S | GFTFSKQGMH | 1219 | MIYYDSSKMYYADTVKG | 1093 | FWWDLDFDH | 1100 |
| CD3_sp11a_VHVL_TW_Y | GFTFSKNGMH | 1215 | MIYYDSSKMYYADTVKG | 1093 | FWWDLDFDH | 1100 |
| CD3_sp11a_VHVL_TW_S | GFTFSKNGMH | 1215 | MIYYDSSKMYYADTVKG | 1093 | FWWDLDFDH | 1100 |
| CD3_sp11a_VHVL_TW_SANSPTM | GFTFSKQGMH | 1219 | MIYYDSSKMYYADTVKG | 1093 | FWWDLDFDH | 1100 |
| CD3_sp11a_VHVL_TT_SANSPTM_Y | GFTFSKQGMH | 1219 | MIYYDSSKMYYADTVKG | 1093 | FWWDLDFDH | 1100 |
| CD3_sp11a_VHVL_TT_SANSPTM_S | GFTFSKQGMH | 1219 | MIYYDSSKMYYADTVKG | 1093 | FWWDLDFDH | 1100 |
| CD3_sp11a_VHVL_TT_Y | GFTFSKNGMH | 1215 | MIYYDSSKMYYADTVKG | 1093 | FWWDLDFDH | 1100 |
| CD3_sp11a_VHVL_TT_S | GFTFSKNGMH | 1215 | MIYYDSSKMYYADTVKG | 1093 | FWWDLDFDH | 1100 |
| CD3_sp11a_VHVL_TT_SANSPTM | GFTFSKQGMH | 1219 | MIYYDSSKMYYADTVKG | 1093 | FWWDLDFDH | 1100 |
| CD3_SP11AVH3_VLK_3_Y | GFTFSKNGMH | 1215 | MIYYDSSKMYYADTVKG | 1093 | YWWDLDFDH | 1126 |
| CD3_SP11AVH3_VLK_3_S | GFTFSKNGMH | 1215 | MIYYDSSKMYYADTVKG | 1093 | SWWDLDFDH | 1127 |
| CD3_SP11AVH3_VLK_3_Y_PTM | GFTFSKNGMH | 1215 | MIYYDSSKMYYADTVKG | 1093 | YWWDLDFDH | 1126 |
| CD3_SP11AVH3_VLK_3_S_PTM | GFTFSKNGMH | 1215 | MIYYDSSKMYYADTVKG | 1093 | SWWDLDFDH | 1127 |
| CD3_SP11AVH3_VLK_3_Y_SW | GFTFSKNGMH | 1215 | MIYYDSSKMYYADTVKG | 1093 | YSWDLDFDH | 1120 |
| CD3_SP11AVH3_VLK_3_S_SW | GFTFSKNGMH | 1215 | MIYYDSSKMYYADTVKG | 1093 | SSWDLDFDH | 1121 |
| CD3_SP11AVH3_VLK_3_Y_PTM_SW | GFTFSKNGMH | 1215 | MIYYDSSKMYYADTVKG | 1093 | YSWDLDFDH | 1120 |
| CD3_SP11AVH3_VLK_3_S_SWPTM | GFTFSKNGMH | 1215 | MIYYDSSKMYYADTVKG | 1093 | SSWDLDFDH | 1121 |
| CD3_SP11AVH3_VLK_SWPTM | GFTFSKNGMH | 1215 | MIYYDSSKMYYADTVKG | 1093 | FSWDLDFDH | 1109 |
| CD3_SP11AVH3_VLK_3_SW | GFTFSKNGMH | 1215 | MIYYDSSKMYYADTVKG | 1093 | FSWDLDFDH | 1109 |

TABLE AG-1-continued

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VH1_VK2_Y | GFTFSK QGMH | 1219 | MIYYDSSKMY YADTVKG | 1093 | YWWDLDFDH | 1126 |
| CD3_sp11a_VH1_VK2_S | GFTFSK QGMH | 1219 | MIYYDSSKMY YADTVKG | 1093 | SWWDLDFDH | 1127 |
| CD3_sp11a_VH1_VK2_Y_PTM | GFTFSK NGMH | 1215 | MIYYDSSKMY YADTVKG | 1093 | YWWDLDFDH | 1126 |
| CD3_sp11a_VH1_VK2_S_PTM | GFTFSK NGMH | 1215 | MIYYDSSKMY YADTVKG | 1093 | SWWDLDFDH | 1127 |
| CD3_sp11a_VH1_VK2_Y_SW | GFTFSK QGMH | 1219 | MIYYDSSKMY YADTVKG | 1093 | YSWDLDFDH | 1120 |
| CD3_sp11a_VH1_VK2_S_SW | GFTFSK QGMH | 1219 | MIYYDSSKMY YADTVKG | 1093 | SSWDLDFDH | 1121 |
| CD3_sp11a_VH1_VK2_Y_PTM | GFTFSK NGMH | 1215 | MIYYDSSKMY YADTVKG | 1093 | YSWDLDFDH | 1120 |
| CD3_sp11a_VH1_VK2_S_PTM_SW | GFTFSK NGMH | 1215 | MIYYDSSKMY YADTVKG | 1093 | SSWDLDFDH | 1121 |
| CD3_sp11a_VH1_VK2_SW | GFTFSK QGMH | 1219 | MIYYDSSKMY YADTVKG | 1093 | FSWDLDFDH | 1109 |
| CD3_sp11a_VH1_VK2_SW_PTM | GFTFSK NGMH | 1215 | MIYYDSSKMY YADTVKG | 1093 | FSWDLDFDH | 1109 |
| CD3_SP11A_VH3_VLK1_Y | GFTFSK NGMH | 1215 | MIYYDSSKMY YADTVKG | 1093 | YWWDLDFDH | 1126 |
| CD3_SP11A_VH3_VLK1_S | GFTFSK NGMH | 1215 | MIYYDSSKMY YADTVKG | 1093 | SWWDLDFDH | 1127 |
| CD3_SP11A_VH3_VLK1_Y_PTM | GFTFSK QGMH | 1219 | MIYYDSSKMY YADTVKG | 1093 | YWWDLDFDH | 1126 |
| CD3_SP11A_VH3_VLK1_S_PTM | GFTFSK QGMH | 1219 | MIYYDSSKMY YADTVKG | 1093 | SWWDLDFDH | 1127 |
| CD3_SP11A_VH3_VLK1_Y_SW | GFTFSK NGMH | 1215 | MIYYDSSKMY YADTVKG | 1093 | YSWDLDFDH | 1120 |
| CD3_SP11A_VH3_VLK1_S_SW | GFTFSK NGMH | 1215 | MIYYDSSKMY YADTVKG | 1093 | SSWDLDFDH | 1121 |
| CD3_SP11A_VH3_VLK1_Y_PTM | GFTFSK QGMH | 1219 | MIYYDSSKMY YADTVKG | 1093 | YWWDLDFDH | 1126 |
| CD3_SP11A_VH3_VLK1_S_PTM_SW | GFTFSK QGMH | 1219 | MIYYDSSKMY YADTVKG | 1093 | SSWDLDFDH | 1121 |
| CD3_SP11A_VH3_VLK1_PTM_SW | GFTFSK QGMH | 1219 | MIYYDSSKMY YADTVKG | 1093 | FSWDLDFDH | 1109 |
| CD3_SP11A_VH3_VLK1_SW | GFTFSK NGMH | 1215 | MIYYDSSKMY YADTVKG | 1093 | FSWDLDFDH | 1109 |
| CD3_SP11A_VH5_VK2_Y | GFTFSK QGMH | 1219 | MIYYDSSKMY YADTVKG | 1093 | YWWDLDFDH | 1126 |
| CD3_SP11A_VH5_VK2_S | GFTFSK QGMH | 1219 | MIYYDSSKMY YADTVKG | 1093 | SWWDLDFDH | 1127 |
| CD3_SP11A_VH5_VK2_Y_PTM | GFTFSK NGMH | 1215 | MIYYDSSKMY YADTVKG | 1093 | YWWDLDFDH | 1126 |
| CD3_SP11A_VH5_VK2_S_PTM | GFTFSK NGMH | 1215 | MIYYDSSKMY YADTVKG | 1093 | SWWDLDFDH | 1127 |

TABLE AG-1-continued

CD3 Binders- Heavy Chain CDR sequences according to combination of Kabat and Chothia numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2_Y_SW | GFTFSKQGMH | 1219 | MIYYDSSKMYYADTVKG | 1093 | YSWDLDFDH | 1120 |
| CD3_SP11A_VH5_VK2_S_SW | GFTFSKQGMH | 1219 | MIYYDSSKMYYADTVKG | 1093 | SSWDLDFDH | 1121 |
| CD3_SP11A_VH5_VK2_Y_PTM_SW | GFTFSKNGMH | 1215 | MIYYDSSKMYYADTVKG | 1093 | YSWDLDFDH | 1120 |
| CD3_SP11A_VH5_VK2_S_PTM_SW | GFTFSKNGMH | 1215 | MIYYDSSKMYYADTVKG | 1093 | SSWDLDFDH | 1121 |
| CD3_SP11A_VH5_VK2_PTM_SW | GFTFSKNGMH | 1215 | MIYYDSSKMYYADTVKG | 1093 | FSWDLDFDH | 1109 |
| CD3_SP11A_VH5_VK2_SW | GFTFSKQGMH | 1219 | MIYYDSSKMYYADTVKG | 1093 | FSWDLDFDH | 1109 |

TABLE AG-2

CD3 Binders- Light Chain CDR sequences according to combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| NOV292 | RSSQSLVRSDGTTYFN | 1128 | RVSNRFS | 1083 | LQSSHFPWT | 1139 |
| NOV123 | RSSQSLIYSIGNTYLH | 1129 | RVSNRFS | 1083 | FQSTHLPYT | 1085 |
| Sp10b | RSSQSLIYSIGNTYLH | 1129 | RVSNRFS | 1083 | FQSTHLPYT | 1085 |
| NOV453 | KASQNINNYLN | 1130 | NTDHLQA | 1136 | LQHRSRYT | 1140 |
| NOV229 | KASQNINNYLN | 1130 | NTDHLQA | 1136 | LQHRSRYT | 1140 |
| NOV110 | RSSQSLVYSHGNTYLH | 1131 | RVSNRFS | 1083 | FQSTHLPYT | 1085 |
| NOV832 | RSSQSLVYSHGNTYLH | 1131 | RVSNRFS | 1083 | FQSTHLPYT | 1085 |
| NOV589 | RSSQSLVRSDGTTYFN | 1128 | RVSNRFS | 1083 | LQSSHFPWT | 1139 |
| NOV580 | KTSQNIDKYLN | 1132 | NTNNLEA | 1137 | LQHRSSYT | 1141 |
| NOV567 | RGSQSIGNSLN | 1133 | STSTLEY | 1138 | LQYATYPYT | 1142 |
| NOV221 | KSSQNIDKYLN | 1134 | NTNNLEA | 1137 | LQHRSGYT | 1143 |
| CD3_sp11a_bkm1 | RSSQSLVRSDGTTYFN | 1128 | RVSNRFS | 1083 | LQSSHFPWT | 1139 |
| CD3_SP11a_bkm2 | RSSQSLVRSDGTTYFN | 1128 | RVSNRFS | 1083 | LQSSHFPWT | 1139 |
| CD3_sp11a_hz0 | RSSQSLVRSDGTTYFN | 1128 | RVSNRFS | 1083 | LQSSHFPWT | 1139 |
| CD3_SP11A_HZ1 | RSSQSLVRSDGTTYFN | 1128 | RVSNRFS | 1083 | LQSSH | 1144 |

TABLE AG-2-continued

CD3 Binders- Light Chain CDR sequences according to combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_sansPTM_hz1 | RSSQSLVRSEGTTYFN | 1135 | RVSNRFS | 1083 | LQSSHFPWT | 1139 |
| CD3_sp11a_sansPTM_rat | RSSQSLVRSEGTTYFN | 1135 | RVSNRFS | 1083 | LQSSHFPWT | 1139 |
| CD3_sp11a_VHVL_YY | RSSQSLVRSDGTTYFN | 1128 | RVSNRFS | 1083 | LQSSHFPWT | 1139 |
| CD3_SP11A_VHVL_SS | RSSQSLVRSDGTTYFN | 1128 | RVSNRFS | 1083 | LQSSHFPWT | 1139 |
| CD3_SP11A_VHVL_WS | RSSQSLVRSDGTTYFN | 1128 | RVSNRFS | 1083 | LQSSHFPWT | 1139 |
| CD3_sp11a_VHVL_SW | RSSQSLVRSDGTTYFN | 1128 | RVSNRFS | 1083 | LQSSHFPWT | 1139 |
| CD3_SP11A_VHVL_TT | RSSQSLVRSDGTTYFN | 1128 | RVSNRFS | 1083 | LQSSHFPWT | 1139 |
| CD3_SP11A_VHVL_TW | RSSQSLVRSDGTTYFN | 1128 | RVSNRFS | 1083 | LQSSHFPWT | 1139 |
| CD3_SP11A_VHVL_WT | RSSQSLVRSDGTTYFN | 1128 | RVSNRFS | 1083 | LQSSHFPWT | 1139 |
| CD3_SP11A_VH3_VLK_3 | RSSQSLVRSEGTTYFN | 1135 | RVSNRFS | 1083 | LQSSHFPWT | 1139 |
| CD3_sp11a_VH1_VK2 | RSSQSLVRSDGTTYFN | 1128 | RVSNRFS | 1083 | LQSSHFPWT | 1139 |
| CD3_SP11A_VH3_VLK1 | RSSQSLVRSEGTTYFN | 1135 | RVSNRFS | 1083 | LQSSHFPWT | 1139 |
| CD3_SP11A_VH5_VK2 | RSSQSLVRSDGTTYFN | 1128 | RVSNRFS | 1083 | LQSSHFPWT | 1139 |
| CD3_sp9aFW1_VL_VH_S56G | KASQNINNYLN | 1130 | NTDHLQA | 1136 | LQHRSRYT | 1140 |
| CD3_SP9AFW4_VL_VH_S56G | KASQNINNYLN | 1130 | NTDHLQA | 1136 | LQHRSRYT | 1140 |
| CD3_sp9aFW1_VLVH | KASQNINNYLN | 1130 | NTDHLQA | 1136 | LQHRSRYT | 1140 |
| CD3_sp9aFW4_VLVH | KASQNINNYLN | 1130 | NTDHLQA | 1136 | LQHRSRYT | 1140 |
| CD3_sp9arabtor_VHVL | KASQNINNYLN | 1130 | NTDHLQA | 1136 | LQHRSRYT | 1140 |
| CD3_sp9arabtor_VLVH | KASQNINNYLN | 1130 | NTDHLQA | 1136 | LQHRSRYT | 1140 |
| CD3_sp11a_VHVL_YY_SANSPTM | RSSQSLVRSEGTTYFN | 1135 | RVSNRFS | 1083 | LQSSHFPWT | 1139 |
| CD3_sp11a_VHVL_YY_SANSPTM_Y | RSSQSLVRSEGTTYFN | 1135 | RVSNRFS | 1083 | LQSSHFPWT | 1139 |
| CD3_sp11a_VHVL_YY_SANSPTM_S | RSSQSLVRSEGTTYFN | 1135 | RVSNRFS | 1083 | LQSSHFPWT | 1139 |
| CD3_sp11a_VHVL_YY_Y | RSSQSLVRSDGTTYFN | 1128 | RVSNRFS | 1083 | LQSSHFPWT | 1139 |
| CD3_sp11a_VHVL_YY_s | RSSQSLVRSDGTTYFN | 1128 | RVSNRFS | 1083 | LQSSHFPWT | 1139 |

TABLE AG-2-continued

CD3 Binders- Light Chain CDR sequences according to combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_SS_SANSPTM | RSSQSLVRSEGTTYFN | 1135 | RVSNRFS | 1083 | LQSSHFPWT | 1139 |
| CD3_sp11a_VHVL_SS_SANSPTM_Y | RSSQSLVRSEGTTYFN | 1135 | RVSNRFS | 1083 | LQSSHFPWT | 1139 |
| CD3_sp11a_VHVL_SS_SANSPTM_S | RSSQSLVRSEGTTYFN | 1135 | RVSNRFS | 1083 | LQSSHFPWT | 1139 |
| CD3_sp11a_VHVL_SS_Y | RSSQSLVRSDGTTYFN | 1128 | RVSNRFS | 1083 | LQSSHFPWT | 1139 |
| CD3_sp11a_VHVL_SS_S | RSSQSLVRSDGTTYFN | 1128 | RVSNRFS | 1083 | LQSSHFPWT | 1139 |
| CD3_sp11a_VHVL_SS_SANSPTM | RSSQSLVRSEGTTYFN | 1135 | RVSNRFS | 1083 | LQSSHFPWT | 1139 |
| CD3_sp11a_VHVL_WS_SANSPTM_Y | RSSQSLVRSEGTTYFN | 1135 | RVSNRFS | 1083 | LQSSHFPWT | 1139 |
| CD3_sp11a_VHVL_WS_SANSPTM_S | RSSQSLVRSEGTTYFN | 1135 | RVSNRFS | 1083 | LQSSHFPWT | 1139 |
| CD3_sp11a_VHVL_WS_Y | RSSQSLVRSDGTTYFN | 1128 | RVSNRFS | 1083 | LQSSHFPWT | 1139 |
| CD3_sp11a_VHVL_WS_S | RSSQSLVRSDGTTYFN | 1128 | RVSNRFS | 1083 | LQSSHFPWT | 1139 |
| CD3_sp11a_VHVL_WS_SANSPTM | RSSQSLVRSEGTTYFN | 1135 | RVSNRFS | 1083 | LQSSHFPWT | 1139 |
| CD3_sp11a_VHVL_SW_SANSPTM_Y | RSSQSLVRSEGTTYFN | 1135 | RVSNRFS | 1083 | LQSSHFPWT | 1139 |
| CD3_sp11a_VHVL_SW_SANSPTM_S | RSSQSLVRSEGTTYFN | 1135 | RVSNRFS | 1083 | LQSSHFPWT | 1139 |
| CD3_sp11a_VHVL_SW_Y | RSSQSLVRSDGTTYFN | 1128 | RVSNRFS | 1083 | LQSSHFPWT | 1139 |
| CD3_sp11a_VHVL_SW_S | RSSQSLVRSDGTTYFN | 1128 | RVSNRFS | 1083 | LQSSHFPWT | 1139 |
| CD3_sp11a_VHVL_SW_SANSPTM | RSSQSLVRSEGTTYFN | 1135 | RVSNRFS | 1083 | LQSSHFPWT | 1139 |
| CD3_sp11a_VHVL_TW_SANSPTM_Y | RSSQSLVRSEGTTYFN | 1135 | RVSNRFS | 1083 | LQSSHFPWT | 1139 |
| CD3_sp11a_VHVL_TW_SANSPTM_S | RSSQSLVRSEGTTYFN | 1135 | RVSNRFS | 1083 | LQSSHFPWT | 1139 |
| CD3_sp11a_VHVL_TW_Y | RSSQSLVRSDGTTYFN | 1128 | RVSNRFS | 1083 | LQSSHFPWT | 1139 |
| CD3_sp11a_VHVL_TW_S | RSSQSLVRSDGTTYFN | 1128 | RVSNRFS | 1083 | LQSSHFPWT | 1139 |
| CD3_sp11a_VHVL_TW_SANSPTM | RSSQSLVRSEGTTYFN | 1135 | RVSNRFS | 1083 | LQSSHFPWT | 1139 |
| CD3_sp11a_VHVL_TT_SANSPTM_Y | RSSQSLVRSEGTTYFN | 1135 | RVSNRFS | 1083 | LQSSHFPWT | 1139 |
| CD3_sp11a_VHVL_TT_SANSPTM_S | RSSQSLVRSEGTTYFN | 1135 | RVSNRFS | 1083 | LQSSHFPWT | 1139 |
| CD3_sp11a_VHVL_TT_Y | RSSQSLVRSDGTTYFN | 1128 | RVSNRFS | 1083 | LQSSHFPWT | 1139 |

TABLE AG-2-continued

CD3 Binders- Light Chain CDR sequences according to combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VHVL_TT_S | RSSQSLVRSDGTTYFN | 1128 | RVSNRFS | 1083 | LQSSHFPWT | 1139 |
| CD3_sp11a_VHVL_TT_SANSPTM | RSSQSLVRSEGTTYFN | 1135 | RVSNRFS | 1083 | LQSSHFPWT | 1139 |
| CD3_SP11AVH3_VLK_3_Y | RSSQSLVRSEGTTYFN | 1135 | RVSNRFS | 1083 | LQSSHFPWT | 1139 |
| CD3_SP11AVH3_VLK_3_S | RSSQSLVRSEGTTYFN | 1135 | RVSNRFS | 1083 | LQSSHFPWT | 1139 |
| CD3_SP11AVH3_VLK_3_Y_PTM | RSSQSLVRSDGTTYFN | 1128 | RVSNRFS | 1083 | LQSSHFPWT | 1139 |
| CD3_SP11AVH3_VLK_3_S_PTM | RSSQSLVRSDGTTYFN | 1128 | RVSNRFS | 1083 | LQSSHFPWT | 1139 |
| CD3_SP11AVH3_VLK_3_Y_SW | RSSQSLVRSEGTTYFN | 1135 | RVSNRFS | 1083 | LQSSHFPWT | 1139 |
| CD3_SP11AVH3_VLK_3_S_SW | RSSQSLVRSEGTTYFN | 1135 | RVSNRFS | 1083 | LQSSHFPWT | 1139 |
| CD3_SP11AVH3_VLK_3_Y_PTM_SW | RSSQSLVRSDGTTYFN | 1128 | RVSNRFS | 1083 | LQSSHFPWT | 1139 |
| CD3_SP11AVH3_VLK_3_S_SWPTM | RSSQSLVRSDGTTYFN | 1128 | RVSNRFS | 1083 | LQSSHFPWT | 1139 |
| CD3_SP11AVH3_VLK_SWPTM | RSSQSLVRSDGTTYFN | 1128 | RVSNRFS | 1083 | LQSSHFPWT | 1139 |
| CD3_SP11AVH3_VLK_3_SW | RSSQSLVRSEGTTYFN | 1135 | RVSNRFS | 1083 | LQSSHFPWT | 1139 |
| CD3_sp11a_VH1_VK2_Y | RSSQSLVRSDGTTYFN | 1128 | RVSNRFS | 1083 | LQSSHFPWT | 1139 |
| CD3_sp11a_VH1_VK2_S | RSSQSLVRSDGTTYFN | 1128 | RVSNRFS | 1083 | LQSSHFPWT | 1139 |
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM | RSSQSLVRSEGTTYFN | 1135 | RVSNRFS | 1083 | LQSSHFPWT | 1139 |
| CD3_sp11a_VH1_VK2_Y_SW | RSSQSLVRSDGTTYFN | 1128 | RVSNRFS | 1083 | LQSSHFPWT | 1139 |
| CD3_sp11a_VH1_VK2_S_SW | RSSQSLVRSDGTTYFN | 1128 | RVSNRFS | 1083 | LQSSHFPWT | 1139 |
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM_SW | RSSQSLVRSEGTTYFN | 1135 | RVSNRFS | 1083 | LQSSHFPWT | 1139 |
| CD3_sp11a_VH1_VK2_SW | RSSQSLVRSDGTTYFN | 1128 | RVSNRFS | 1083 | LQSSHFPWT | 1139 |
| CD3_sp11a_VH1_VK2_SW_PTM | RSSQSLVRSEGTTYFN | 1135 | RVSNRFS | 1083 | LQSSHFPWT | 1139 |
| CD3_SP11A_VH3_VLK1_Y | RSSQSLVRSEGTTYFN | 1135 | RVSNRFS | 1083 | LQSSHFPWT | 1139 |
| CD3_SP11A_VH3_VLK1_S | RSSQSLVRSEGTTYFN | 1135 | RVSNRFS | 1083 | LQSSHFPWT | 1139 |

TABLE AG-2-continued

CD3 Binders- Light Chain CDR sequences according to combination of Kabat and Chothia numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH3_VLK1_Y_PTM | RSSQSLVRSEGTTYFN | 1135 | RVSNRFS | 1083 | LQSSHFPWT | 1139 |
| CD3_SP11A_VH3_VLK1_S_PTM | RSSQSLVRSDGTTYFN | 1128 | RVSNRFS | 1083 | LQSSHFPWT | 1139 |
| CD3_SP11A_VH3_VLK1_Y_SW | RSSQSLVRSEGTTYFN | 1135 | RVSNRFS | 1083 | LQSSHFPWT | 1139 |
| CD3_SP11A_VH3_VLK1_S_SW | RSSQSLVRSEGTTYFN | 1135 | RVSNRFS | 1083 | LQSSHFPWT | 1139 |
| CD3_SP11A_VH3_VLK1_Y_PTM | RSSQSLVRSEGTTYFN | 1135 | RVSNRFS | 1083 | LQSSHFPWT | 1139 |
| CD3_SP11A_VH3_VLK1_S_PTM_SW | RSSQSLVRSDGTTYFN | 1128 | RVSNRFS | 1083 | LQSSHFPWT | 1139 |
| CD3_SP11A_VH3_VLK1PTM_SW | RSSQSLVRSDGTTYFN | 1128 | RVSNRFS | 1083 | LQSSHFPWT | 1139 |
| CD3_SP11A_VH3_VLK1_SW | RSSQSLVRSEGTTYFN | 1135 | RVSNRFS | 1083 | LQSSHFPWT | 1139 |
| CD3_SP11A_VH5_VK2_Y | RSSQSLVRSDGTTYFN | 1128 | RVSNRFS | 1083 | LQSSHFPWT | 1139 |
| CD3_SP11A_VH5_VK2_S | RSSQSLVRSDGTTYFN | 1128 | RVSNRFS | 1083 | LQSSHFPWT | 1139 |
| CD3_SP11A_VH5_VK2_Y_PTM | RSSQSLVRSDGTTYFN | 1128 | RVSNRFS | 1083 | LQSSHFPWT | 1139 |
| CD3_SP11A_VH5_VK2_S_PTM | RSSQSLVRSDGTTYFN | 1128 | RVSNRFS | 1083 | LQSSHFPWT | 1139 |
| CD3_SP11A_VH5_VK2_Y_SW | RSSQSLVRSDGTTYFN | 1128 | RVSNRFS | 1083 | LQSSHFPWT | 1139 |
| CD3_SP11A_VH5_VK2_S_SW | RSSQSLVRSDGTTYFN | 1128 | RVSNRFS | 1083 | LQSSHFPWT | 1139 |
| CD3_SP11A_VH5_VK2_Y_PTM_SW | RSSQSLVRSDGTTYFN | 1128 | RVSNRFS | 1083 | LQSSHFPWT | 1139 |
| CD3_SP11A_VH5_VK2_S_PTM_SW | RSSQSLVRSDGTTYFN | 1128 | RVSNRFS | 1083 | LQSSHFPWT | 1139 |
| CD3_SP11A_VH5_VK2_PTM_SW | RSSQSLVRSDGTTYFN | 1128 | RVSNRFS | 1083 | LQSSHFPWT | 1139 |
| CD3_SP11A_VH5_VK2_SW | RSSQSLVRSDGTTYFN | 1128 | RVSNRFS | 1083 | LQSSHFPWT | 1139 |

TABLE AH-1

CD3 Binders- Heavy Chain CDR sequences according to combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV292 | GFTFSKNGMH | 1215 | MIYYDSSKMYYADTVKG | 1093 | ASFWWNDLDFDH | 1174 |
| NOV123 | GYTFTSYYIY | 1072 | YIYPGHDAIYYSENFKG | 1094 | VRPNTMMAPLAY | 1175 |
| Sp10b | GYTFTSYYIY | 1072 | YIYPGHDAIYYSENFKG | 1094 | VRPNTMMAPLAY | 1175 |

TABLE AH-1-continued

CD3 Binders- Heavy Chain CDR sequences according to combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV453 | GFSLTTYNVH | 1216 | RMRYSGDTSFNAALTS | 1095 | TSDPMYIPNYSYGVMNA | 1176 |
| NOV229 | GFSLTTYNVH | 1216 | RMRYSGDTSFNAALTS | 1095 | ARDPMYIPNYSYGVMNA | 1177 |
| NOV110 | GYTFTSYYIY | 1072 | YIYPANGGIYYSEKFKG | 1096 | ARPVTMMAPLVF | 1178 |
| NOV832 | GYTFTSYYIY | 1072 | YIYPANGGIYYSEKFKG | 1096 | ARPVTMMAPLVF | 1178 |
| NOV589 | GFTFSKNGMH | 1215 | MIYYDSSRMYYADTVKG | 1097 | ASFWWDLDFDY | 1179 |
| NOV580 | GFSLTTYNIH | 1217 | RMRYSGDTSYSSALKS | 1098 | TRDPMYIPGYSYGVMNA | 1180 |
| NOV567 | GFAFRKYGMS | 1218 | LIYYDSSKMNYADTVKG | 1099 | AALNSEYD | 1041 |
| NOV221 | GFSLTTYNIH | 1217 | RMRYSGDTSYSSALKS | 1098 | TRDPMYIPGYSYGVMNA | 1180 |
| CD3_sp11a_bkm1 | GFTFSKNGMH | 1215 | MIYYDSSKMYYADTVKG | 1093 | ASFWWDLDFDH | 1174 |
| CD3_SP11a_bkm2 | GFTFSKNGMH | 1215 | MIYYDSSKMYYADTVKG | 1093 | AKFWWDLDFDH | 1181 |
| CD3_sp11a_hz0 | GFTFSKNGMH | 1215 | MIYYDSSKMYYADTVKG | 1093 | AKFWWDLDFDH | 1181 |
| CD3_SP11A_HZ1 | GFTFSKNGMH | 1215 | MIYYDSSKMYYADTVKG | 1093 | ASFWWDLDFDH | 1174 |
| CD3_sp11a_sansPTM_hz1 | GFTFSKQGMH | 1219 | MIYYDSSKMYYADTVKG | 1093 | ASFWWDLDFDH | 1174 |
| CD3_sp11a_sansPTM_rat | GFTFSKQGMH | 1219 | MIYYDSSKMYYADTVKG | 1093 | ASFWWDLDFDH | 1174 |
| CD3_sp11a_VHVL_YY | GFTFSKNGMH | 1215 | MIYYDSSKMYYADTVKG | 1093 | ASFYYDLDFDH | 1182 |
| CD3_SP11A_VHVL_SS | GFTFSKNGMH | 1215 | MIYYDSSKMYYADTVKG | 1093 | ASFSSDLDFDH | 1183 |
| CD3_SP11A_VHVL_WS | GFTFSKNGMH | 1215 | MIYYDSSKMYYADTVKG | 1093 | ASFWSDLDFDH | 1184 |
| CD3_sp11a_VHVL_SW | GFTFSKNGMH | 1215 | MIYYDSSKMYYADTVKG | 1093 | ASFSWDLDFDH | 1185 |
| CD3_SP11A_VHVL_TT | GFTFSKNGMH | 1215 | MIYYDSSKMYYADTVKG | 1093 | ASFTTDLDFDH | 1186 |
| CD3_SP11A_VHVL_TW | GFTFSKNGMH | 1215 | MIYYDSSKMYYADTVKG | 1093 | ASFTWDLDFDH | 1187 |
| CD3_SP11A_VHVL_WT | GFTFSKNGMH | 1215 | MIYYDSSKMYYADTVKG | 1093 | ASFWTDLDFDH | 1188 |
| CD3_SP11A VH3_VLK_3 | GFTFSKNGMH | 1215 | MIYYDSSKMYYADTVKG | 1093 | ASFWWDLDFDH | 1174 |
| CD3_sp11a_VH1_VK2 | GFTFSKQGMH | 1219 | MIYYDSSKMYYADTVKG | 1093 | ASFWWDLDFDH | 1174 |
| CD3_SP11A_VH3_VLK1 | GFTFSKNGMH | 1215 | MIYYDSSKMYYADTVKG | 1093 | ASFWWDLDFDH | 1174 |

TABLE AH-1-continued

CD3 Binders- Heavy Chain CDR sequences according to combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2 | GFTFSKQGMH | 1219 | MIYYDSSKMYYADTVKG | 1093 | ASFWWDLDFDH | 1174 |
| CD3_sp9aFW1_VL_VH_S56G | GFSLTTYNVH | 1216 | RMRYSGDTSFNAALTS | 1095 | ASDPMYIPNYAYGVMNA | 1189 |
| CD3_SP9AFW4_VL_VH_S56G | GFSLTTYNVH | 1216 | RMRYSGDTSFNAALTS | 1095 | ASDPMYIPNYAYGVMNA | 1189 |
| CD3_sp9aFW1_VLVH | GFSLTTYNVH | 1216 | RMRYSGDTSFNAALTS | 1095 | ASDPMYIPNYAYGVMNA | 1189 |
| CD3_sp9aFW4_VLVH | GFSLTTYNVH | 1216 | RMRYSGDTSFNAALTS | 1095 | ASDPMYIPNYAYGVMNA | 1189 |
| CD3_sp9arabtor_VHVL | GFSLTTYNVH | 1216 | RMRYSGDTSFNAALTS | 1095 | ASDPMYIPNYAYGVMNA | 1189 |
| CD3_sp9arabtor_VLVH | GFSLTTYNVH | 1216 | RMRYSGDTSFNAALTS | 1095 | ASDPMYIPNYAYGVMNA | 1189 |
| CD3_SP11AVH3_VLK_3_Y | GFTFSKNGMH | 1215 | MIYYDSSKMYYADTVKG | 1093 | ASYWDLDFDH | 1202 |
| CD3_SP11AVH3_VLK_3_S | GFTFSKNGMH | 1215 | MIYYDSSKMYYADTVKG | 1093 | ASSWWDLDFDH | 1203 |
| CD3_SP11AVH3_VLK_3_Y_PTM | GFTFSKNGMH | 1215 | MIYYDSSKMYYADTVKG | 1093 | ASYWWDLDFDH | 1202 |
| CD3_SP11AVH3_VLK_3_S_PTM | GFTFSKNGMH | 1215 | MIYYDSSKMYYADTVKG | 1093 | ASSWWDLDFDH | 1203 |
| CD3_SP11AVH3_VLK_3_Y_SW | GFTFSKNGMH | 1215 | MIYYDSSKMYYADTVKG | 1093 | ASYSWDLDFDH | 1196 |
| CD3_SP11AVH3_VLK_3_S_SW | GFTFSKNGMH | 1215 | MIYYDSSKMYYADTVKG | 1093 | ASSSWDLDFDH | 1197 |
| CD3_SP11AVH3_VLK_3_Y_PTM_SW | GFTFSKNGMH | 1215 | MIYYDSSKMYYADTVKG | 1093 | ASYSWDLDFDH | 1196 |
| CD3_SP11AVH3_VLK_3_S_SWPTM | GFTFSKNGMH | 1215 | MIYYDSSKMYYADTVKG | 1093 | ASSSWDLDFDH | 1197 |
| CD3_SP11AVH3_VLK_SWPTM | GFTFSKNGMH | 1215 | MIYYDSSKMYYADTVKG | 1093 | ASFSWDLDFDH | 1185 |
| CD3_SP11AVH3_VLK_3_SW | GFTFSKNGMH | 1215 | MIYYDSSKMYYADTVKG | 1093 | ASFSWDLDFDH | 1185 |
| CD3_sp11a_VH1_VK2_Y | GFTFSKQGMH | 1219 | MIYYDSSKMYYADTVKG | 1093 | ASYWDLDFDH | 1202 |
| CD3_sp11a_VH1_VK2_S | GFTFSKQGMH | 1219 | MIYYDSSKMYYADTVKG | 1093 | ASSWWDLDFDH | 1203 |
| CD3_sp11a_VH1_VK2_Y_PTM | GFTFSKNGMH | 1215 | MIYYDSSKMYYADTVKG | 1093 | ASYWWDLDFDH | 1202 |
| CD3_sp11a_VH1_VK2_S_PTM | GFTFSKNGMH | 1215 | MIYYDSSKMYYADTVKG | 1093 | ASSWWDLDFDH | 1203 |
| CD3_sp11a_VH1_VK2_Y_SW | GFTFSKQGMH | 1219 | MIYYDSSKMYYADTVKG | 1093 | ASYSWDLDFDH | 1196 |
| CD3_sp11a_VH1_VK2_S_SW | GFTFSKQGMH | 1219 | MIYYDSSKMYYADTVKG | 1093 | ASSSWDLDFDH | 1197 |
| CD3_sp11a_VH1_VK2_Y_PTM | GFTFSKNGMH | 1215 | MIYYDSSKMYYADTVKG | 1093 | ASYSWDLDFDH | 1196 |

TABLE AH-1-continued

CD3 Binders- Heavy Chain CDR sequences according to combination of Kabat and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_sp11a_VH1_VK2_S_PTM_SW | GFTFSKNGMH | 1215 | MIYYDSSKMYYADTVKG | 1093 | ASSSWDLDFDH | 1197 |
| CD3_sp11a_VH1_VK2_SW | GFTFSKQGMH | 1219 | MIYYDSSKMYYADTVKG | 1093 | ASFSWDLDFDH | 1185 |
| CD3_sp11a_VH1_VK2_SW_PTM | GFTFSKNGMH | 1215 | MIYYDSSKMYYADTVKG | 1093 | ASFSWDLDFDH | 1185 |
| CD3_SP11A_VH3_VLK1_Y | GFTFSKNGMH | 1215 | MIYYDSSKMYYADTVKG | 1093 | ASYWWDLDFDH | 1202 |
| CD3_SP11A_VH3_VLK1_S | GFTFSKNGMH | 1215 | MIYYDSSKMYYADTVKG | 1093 | ASSWWDLDFDH | 1203 |
| CD3_SP11A_VH3_VLK1_Y_PTM | GFTFSKQGMH | 1219 | MIYYDSSKMYYADTVKG | 1093 | ASYWWDLDFDH | 1202 |
| CD3_SP11A_VH3_VLK1_S_PTM | GFTFSKQGMH | 1219 | MIYYDSSKMYYADTVKG | 1093 | ASSWWDLDFDH | 1203 |
| CD3_SP11A_VH3_VLK1_Y_SW | GFTFSKNGMH | 1215 | MIYYDSSKMYYADTVKG | 1093 | ASYSWDLDFDH | 1196 |
| CD3_SP11A_VH3_VLK1_S_SW | GFTFSKNGMH | 1215 | MIYYDSSKMYYADTVKG | 1093 | ASSSWDLDFDH | 1197 |
| CD3_SP11A_VH3_VLK1_Y_PTM | GFTFSKQGMH | 1219 | MIYYDSSKMYYADTVKG | 1093 | ASYWWDLDFDH | 1202 |
| CD3_SP11A_VH3_VLK1_S_PTM_SW | GFTFSKQGMH | 1219 | MIYYDSSKMYYADTVKG | 1093 | ASSSWDLDFDH | 1197 |
| CD3_SP11A_VH3_VLK1_PTM_SW | GFTFSKQGMH | 1219 | MIYYDSSKMYYADTVKG | 1093 | ASFSWDLDFDH | 1185 |
| CD3_SP11A_VH3_VLK1_SW | GFTFSKNGMH | 1215 | MIYYDSSKMYYADTVKG | 1093 | ASFSWDLDFDH | 1185 |
| CD3_SP11A_VH5_VK2_Y | GFTFSKQGMH | 1219 | MIYYDSSKMYYADTVKG | 1093 | ASYWWDLDFDH | 1202 |
| CD3_SP11A_VH5_VK2_S | GFTFSKQGMH | 1219 | MIYYDSSKMYYADTVKG | 1093 | ASSWWDLDFDH | 1203 |
| CD3_SP11A_VH5_VK2_Y_PTM | GFTFSKNGMH | 1215 | MIYYDSSKMYYADTVKG | 1093 | ASYWWDLDFDH | 1202 |
| CD3_SP11A_VH5_VK2_S_PTM | GFTFSKNGMH | 1215 | MIYYDSSKMYYADTVKG | 1093 | ASSWWDLDFDH | 1203 |
| CD3_SP11A_VH5_VK2_Y_SW | GFTFSKQGMH | 1219 | MIYYDSSKMYYADTVKG | 1093 | ASYSWDLDFDH | 1196 |
| CD3_SP11A_VH5_VK2_S_SW | GFTFSKQGMH | 1219 | MIYYDSSKMYYADTVKG | 1093 | ASSSWDLDFDH | 1197 |
| CD3_SP11A_VH5_VK2_Y_PTM_SW | GFTFSKNGMH | 1215 | MIYYDSSKMYYADTVKG | 1093 | ASYSWDLDFDH | 1196 |
| CD3_SP11A_VH5_VK2_S_PTM_SW | GFTFSKNGMH | 1215 | MIYYDSSKMYYADTVKG | 1093 | ASSSWDLDFDH | 1197 |
| CD3_SP11A_VH5_VK2_PTM_SW | GFTFSKNGMH | 1215 | MIYYDSSKMYYADTVKG | 1093 | ASFSWDLDFDH | 1185 |
| CD3_SP11A_VH5_VK2_SW | GFTFSKQGMH | 1219 | MIYYDSSKMYYADTVKG | 1093 | ASFSWDLDFDH | 1185 |

TABLE AH-2

CD3 Binders- Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| NOV292 | RSSQSLVRSDGTTYFN | 1128 | RVSNRFS | 1083 | LQSSHFPWT | 1139 |
| NOV123 | RSSQSLIYSIGNTYLH | 1129 | RVSNRFS | 1083 | FQSTHLPYT | 1085 |
| Sp10b | RSSQSLIYSIGNTYLH | 1129 | RVSNRFS | 1083 | FQSTHLPYT | 1085 |
| NOV453 | KASQNINNYLN | 1130 | NTDHLQAGVP | 1212 | LQHRSRYT | 1140 |
| NOV229 | KASQNINNYLN | 1130 | NTDHLQAGVP | 1212 | LQHRSRYT | 1140 |
| NOV110 | RSSQSLVYSHGNTYLH | 1131 | RVSNRFS | 1083 | FQSTHLPYT | 1085 |
| NOV832 | RSSQSLVYSHGNTYLH | 1131 | RVSNRFS | 1083 | FQSTHLPYT | 1085 |
| NOV589 | RSSQSLVRSDGTTYFN | 1128 | RVSNRFS | 1083 | LQSSHFPWT | 1139 |
| NOV580 | KTSQNIDKYLN | 1132 | NTNNLEAGVP | 1213 | LQHRSSYT | 1141 |
| NOV567 | RGSQSIGNSLN | 1133 | STSTLEYGVP | 1214 | LQYATYPYT | 1142 |
| NOV221 | KSSQNIDKYLN | 1134 | NTNNLEAGVP | 1213 | LQHRSGYT | 1143 |
| CD3_sp11a_bkm1 | RSSQSLVRSDGTTYFN | 1128 | RVSNRFS | 1083 | LQSSHFPWT | 1139 |
| CD3_SP11a_bkm2 | RSSQSLVRSDGTTYFN | 1128 | RVSNRFS | 1083 | LQSSHFPWT | 1139 |
| CD3_sp11a_hz0 | RSSQSLVRSDGTTYFN | 1128 | RVSNRFS | 1083 | LQSSHFPWT | 1139 |
| CD3_SP11A_HZ1 | RSSQSLVRSDGTTYFN | 1128 | RVSNRFS | 1083 | LQSSH | 1144 |
| CD3_sp11a_sansPTM_hz1 | RSSQSLVRSEGTTYFN | 1135 | RVSNRFS | 1083 | LQSSHFPWT | 1139 |
| CD3_sp11a_sansPTM_rat | RSSQSLVRSEGTTYFN | 1135 | RVSNRFS | 1083 | LQSSHFPWT | 1139 |
| CD3_sp11a_VHVL_YY | RSSQSLVRSDGTTYFN | 1128 | RVSNRFS | 1083 | LQSSHFPWT | 1139 |
| CD3_SP11A_VHVL_SS | RSSQSLVRSDGTTYFN | 1128 | RVSNRFS | 1083 | LQSSHFPWT | 1139 |
| CD3_SP11A_VHVL_WS | RSSQSLVRSDGTTYFN | 1128 | RVSNRFS | 1083 | LQSSHFPWT | 1139 |
| CD3_sp11a_VHVL_SW | RSSQSLVRSDGTTYFN | 1128 | RVSNRFS | 1083 | LQSSHFPWT | 1139 |
| CD3_SP11A_VHVL_TT | RSSQSLVRSDGTTYFN | 1128 | RVSNRFS | 1083 | LQSSHFPWT | 1139 |
| CD3_SP11A_VHVL_TW | RSSQSLVRSDGTTYFN | 1128 | RVSNRFS | 1083 | LQSSHFPWT | 1139 |
| CD3_SP11A_VHVL_WT | RSSQSLVRSDGTTYFN | 1128 | RVSNRFS | 1083 | LQSSHFPWT | 1139 |
| CD3_SP11A VH3_VLK_3 | RSSQSLVRSEGTTYFN | 1135 | RVSNRFS | 1083 | LQSSHFPWT | 1139 |

TABLE AH-2-continued

CD3 Binders- Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2 | RSSQSLVRSDGTTYFN | 1128 | RVSNRFS | 1083 | LQSSHFPWT | 1139 |
| CD3_SP11A_VH3_VLK1 | RSSQSLVRSEGTTYFN | 1135 | RVSNRFS | 1083 | LQSSHFPWT | 1139 |
| CD3_SP11A_VH5_VK2 | RSSQSLVRSDGTTYFN | 1128 | RVSNRFS | 1083 | LQSSHFPWT | 1139 |
| CD3_sp9aFW1_VL_VH_S56G | KASQNINNYLN | 1130 | NTDHLQAGVP | 1212 | LQHRSRYT | 1140 |
| CD3_SP9AFW4_VL_VH_S56G | KASQNINNYLN | 1130 | NTDHLQAGVP | 1212 | LQHRSRYT | 1140 |
| CD3_sp9aFW1_VLVH | KASQNINNYLN | 1130 | NTDHLQAGVP | 1212 | LQHRSRYT | 1140 |
| CD3_sp9aFW4_VLVH | KASQNINNYLN | 1130 | NTDHLQAGVP | 1212 | LQHRSRYT | 1140 |
| CD3_sp9arabtor_VHVL | KASQNINNYLN | 1130 | NTDHLQAGVP | 1212 | LQHRSRYT | 1140 |
| CD3_sp9arabtor_VLVH | KASQNINNYLN | 1130 | NTDHLQAGVP | 1212 | LQHRSRYT | 1140 |
| CD3_SP11AVH3_VLK_3_Y | RSSQSLVRSEGTTYFN | 1135 | RVSNRFS | 1083 | LQSSHFPWT | 1139 |
| CD3_SP11AVH3_VLK_3_S | RSSQSLVRSEGTTYFN | 1135 | RVSNRFS | 1083 | LQSSHFPWT | 1139 |
| CD3_SP11AVH3_VLK_3_Y_PTM | RSSQSLVRSDGTTYFN | 1128 | RVSNRFS | 1083 | LQSSHFPWT | 1139 |
| CD3_SP11AVH3_VLK_3_S_PTM | RSSQSLVRSDGTTYFN | 1128 | RVSNRFS | 1083 | LQSSHFPWT | 1139 |
| CD3_SP11AVH3_VLK_3_Y_SW | RSSQSLVRSEGTTYFN | 1135 | RVSNRFS | 1083 | LQSSHFPWT | 1139 |
| CD3_SP11AVH3_VLK_3_S_SW | RSSQSLVRSEGTTYFN | 1135 | RVSNRFS | 1083 | LQSSHFPWT | 1139 |
| CD3_SP11AVH3_VLK_3_Y_PTM_SW | RSSQSLVRSDGTTYFN | 1128 | RVSNRFS | 1083 | LQSSHFPWT | 1139 |
| CD3_SP11AVH3_VLK_3_S_SWPTM | RSSQSLVRSDGTTYFN | 1128 | RVSNRFS | 1083 | LQSSHFPWT | 1139 |
| CD3_SP11AVH3_VLK_SWPTM | RSSQSLVRSDGTTYFN | 1128 | RVSNRFS | 1083 | LQSSHFPWT | 1139 |
| CD3_SP11AVH3_VLK_3_SW | RSSQSLVRSEGTTYFN | 1135 | RVSNRFS | 1083 | LQSSHFPWT | 1139 |
| CD3_sp11a_VH1_VK2_Y | RSSQSLVRSDGTTYFN | 1128 | RVSNRFS | 1083 | LQSSHFPWT | 1139 |
| CD3_sp11a_VH1_VK2_S | RSSQSLVRSDGTTYFN | 1128 | RVSNRFS | 1083 | LQSSHFPWT | 1139 |
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM | RSSQSLVRSEGTTYFN | 1135 | RVSNRFS | 1083 | LQSSHFPWT | 1139 |
| CD3_sp11a_VH1_VK2_Y_SW | RSSQSLVRSDGTTYFN | 1128 | RVSNRFS | 1083 | LQSSHFPWT | 1139 |

TABLE AH-2-continued

CD3 Binders- Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_sp11a_VH1_VK2_S_SW | RSSQSLVRSDGTTYFN | 1128 | RVSNRFS | 1083 | LQSSHFPWT | 1139 |
| CD3_sp11a_VH1_VK2_Y_PTM | RSSQSLVRSEGTTYFN | 1135 | RVSNRFS | 1083 | LQSSHFPWT | 1139 |
| CD3_sp11a_VH1_VK2_S_PTM_SW | RSSQSLVRSEGTTYFN | 1135 | RVSNRFS | 1083 | LQSSHFPWT | 1139 |
| CD3_sp11a_VH1_VK2_SW | RSSQSLVRSDGTTYFN | 1128 | RVSNRFS | 1083 | LQSSHFPWT | 1139 |
| CD3_sp11a_VH1_VK2_SW_PTM | RSSQSLVRSEGTTYFN | 1135 | RVSNRFS | 1083 | LQSSHFPWT | 1139 |
| CD3_SP11A_VH3_VLK1_Y | RSSQSLVRSEGTTYFN | 1135 | RVSNRFS | 1083 | LQSSHFPWT | 1139 |
| CD3_SP11A_VH3_VLK1_S | RSSQSLVRSEGTTYFN | 1135 | RVSNRFS | 1083 | LQSSHFPWT | 1139 |
| CD3_SP11A_VH3_VLK1_Y_PTM | RSSQSLVRSDGTTYFN | 1128 | RVSNRFS | 1083 | LQSSHFPWT | 1139 |
| CD3_SP11A_VH3_VLK1_S_PTM | RSSQSLVRSDGTTYFN | 1128 | RVSNRFS | 1083 | LQSSHFPWT | 1139 |
| CD3_SP11A_VH3_VLK1_Y_SW | RSSQSLVRSEGTTYFN | 1135 | RVSNRFS | 1083 | LQSSHFPWT | 1139 |
| CD3_SP11A_VH3_VLK1_S_SW | RSSQSLVRSEGTTYFN | 1135 | RVSNRFS | 1083 | LQSSHFPWT | 1139 |
| CD3_SP11A_VH3_VLK1_Y_PTM | RSSQSLVRSDGTTYFN | 1128 | RVSNRFS | 1083 | LQSSHFPWT | 1139 |
| CD3_SP11A_VH3_VLK1_S_PTM_SW | RSSQSLVRSDGTTYFN | 1128 | RVSNRFS | 1083 | LQSSHFPWT | 1139 |
| CD3_SP11A_VH3_VLK1_PTM_SW | RSSQSLVRSDGTTYFN | 1128 | RVSNRFS | 1083 | LQSSHFPWT | 1139 |
| CD3_SP11A_VH3_VLK1_SW | RSSQSLVRSEGTTYFN | 1135 | RVSNRFS | 1083 | LQSSHFPWT | 1139 |
| CD3_SP11A_VH5_VK2_Y | RSSQSLVRSDGTTYFN | 1128 | RVSNRFS | 1083 | LQSSHFPWT | 1139 |
| CD3_SP11A_VH5_VK2_S | RSSQSLVRSDGTTYFN | 1128 | RVSNRFS | 1083 | LQSSHFPWT | 1139 |
| CD3_SP11A_VH5_VK2_Y_PTM | RSSQSLVRSDGTTYFN | 1128 | RVSNRFS | 1083 | LQSSHFPWT | 1139 |
| CD3_SP11A_VH5_VK2_S_PTM | RSSQSLVRSDGTTYFN | 1128 | RVSNRFS | 1083 | LQSSHFPWT | 1139 |
| CD3_SP11A_VH5_VK2_Y_SW | RSSQSLVRSDGTTYFN | 1128 | RVSNRFS | 1083 | LQSSHFPWT | 1139 |
| CD3_SP11A_VH5_VK2_S_SW | RSSQSLVRSDGTTYFN | 1128 | RVSNRFS | 1083 | LQSSHFPWT | 1139 |
| CD3_SP11A_VH5_VK2_Y_PTM_SW | RSSQSLVRSDGTTYFN | 1128 | RVSNRFS | 1083 | LQSSHFPWT | 1139 |
| CD3_SP11A_VH5_VK2_S_PTM_SW | RSSQSLVRSDGTTYFN | 1128 | RVSNRFS | 1083 | LQSSHFPWT | 1139 |

TABLE AH-2-continued

CD3 Binders- Light Chain CDR sequences according to combination of Kabat and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH5_VK2_PTM_SW | RSSQSLVRSDGTTYFN | 1128 | RVSNRFS | 1083 | LQSSHFPWT | 1139 |
| CD3_SP11A_VH5_VK2_SW | RSSQSLVRSDGTTYFN | 1128 | RVSNRFS | 1083 | LQSSHFPWT | 1139 |

TABLE AI-1

CD3 Binders- Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| NOV292 | GFTFSKNG | 1167 | YYDSSK | 1148 | ASFWWDLDFDH | 1174 |
| NOV123 | GYTFTSYY | 1073 | YPGHDA | 1149 | VRPNTMMAPLAY | 1175 |
| Sp10b | GYTFTSYY | 1073 | YPGHDA | 1149 | VRPNTMMAPLAY | 1175 |
| NOV453 | GFSLTTYN | 1056 | RYSGD | 1060 | TSDPMYIPNYSYGVMNA | 1176 |
| NOV229 | GFSLTTYN | 1056 | RYSGD | 1060 | ARDPMYIPNYSYGVMNA | 1177 |
| NOV110 | GYTFTSYY | 1073 | YPANGG | 1150 | ARPVTMMAPLVF | 1178 |
| NOV832 | GYTFTSYY | 1073 | YPANGG | 1150 | ARPVTMMAPLVF | 1178 |
| NOV589 | GFTFSKNG | 1167 | YYDSSR | 1151 | ASFWWDLDFDY | 1179 |
| NOV580 | GFSLTTYN | 1056 | RYSGD | 1060 | TRDPMYIPGYSYGVMNA | 1180 |
| NOV567 | GFAFRKYG | 1168 | YYDSSK | 1148 | AALNSEYD | 1041 |
| NOV221 | GFSLTTYN | 1056 | RYSGD | 1060 | TRDPMYIPGYSYGVMNA | 1180 |
| CD3_sp11a_bkm1 | GFTFSKNG | 1167 | YYDSSK | 1148 | ASFWWDLDFDH | 1174 |
| CD3_SP11a_bkm2 | GFTFSKNG | 1167 | YYDSSK | 1148 | AKFWWDLDFDH | 1181 |
| CD3_sp11a_hz0 | GFTFSKNG | 1167 | YYDSSK | 1148 | AKFWWDLDFDH | 1181 |
| CD3_SP11A_HZ1 | GFTFSKNG | 1167 | YYDSSK | 1148 | ASFWWDLDFDH | 1174 |
| CD3_sp11a_sansPTM_hz1 | GFTFSKQG | 1169 | YYDSSK | 1148 | ASFWWDLDFDH | 1174 |
| CD3_sp11a_sansPTM_rat | GFTFSKQG | 1169 | YYDSSK | 1148 | ASFWWDLDFDH | 1174 |
| CD3_sp11a_VHVL_YY | GFTFSKNG | 1167 | YYDSSK | 1148 | ASFYYDLDFDH | 1182 |
| CD3_SP11A_VHVL_SS | GFTFSKNG | 1167 | YYDSSK | 1148 | ASFSSDLDFDH | 1183 |

TABLE AI-1-continued

CD3 Binders- Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VHVL_WS | GFTFSKNG | 1167 | YYDSSK | 1148 | ASFWSDLDFDH | 1184 |
| CD3_sp11a_VHVL_SW | GFTFSKNG | 1167 | YYDSSK | 1148 | ASFSWDLDFDH | 1185 |
| CD3_SP11A_VHVL_TT | GFTFSKNG | 1167 | YYDSSK | 1148 | ASFTTDLDFDH | 1186 |
| CD3_SP11A_VHVL_TW | GFTFSKNG | 1167 | YYDSSK | 1148 | ASFTWDLDFDH | 1187 |
| CD3_SP11A_VHVL_WT | GFTFSKNG | 1167 | YYDSSK | 1148 | ASFWTDLDFDH | 1188 |
| CD3_SP11A_VH3_VLK_3 | GFTFSKNG | 1167 | YYDSSK | 1148 | ASFWWDLDFDH | 1174 |
| CD3_sp11a_VH1_VK2 | GFTFSKQG | 1169 | YYDSSK | 1148 | ASFWWDLDFDH | 1174 |
| CD3_SP11A_VH3_VLK1 | GFTFSKNG | 1167 | YYDSSK | 1148 | ASFWWDLDFDH | 1174 |
| CD3_SP11A_VH5_VK2 | GFTFSKQG | 1169 | YYDSSK | 1148 | ASFWWDLDFDH | 1174 |
| CD3_sp9aFW1_VL_VH_S56G | GFSLTTYN | 1056 | RYSGD | 1060 | ASDPMYIPNYAYGVMNA | 1189 |
| CD3_SP9AFW4_VL_VH_S56G | GFSLTTYN | 1056 | RYSGD | 1060 | ASDPMYIPNYAYGVMNA | 1189 |
| CD3_sp9aFW1_VLVH | GFSLTTYN | 1056 | RYSGD | 1060 | ASDPMYIPNYAYGVMNA | 1189 |
| CD3_sp9aFW4_VLVH | GFSLTTYN | 1056 | RYSGD | 1060 | ASDPMYIPNYAYGVMNA | 1189 |
| CD3_sp9arabtor_VHVL | GFSLTTYN | 1056 | RYSGD | 1060 | ASDPMYIPNYAYGVMNA | 1189 |
| CD3_sp9arabtor_VLVH | GFSLTTYN | 1056 | RYSGD | 1060 | ASDPMYIPNYAYGVMNA | 1189 |
| CD3_SP11AVH3_VLK_3_Y | GFTFSKNG | 1167 | YYDSSK | 1148 | ASYWWDLDFDH | 1202 |
| CD3_SP11AVH3_VLK_3_S | GFTFSKNG | 1167 | YYDSSK | 1148 | ASSWWDLDFDH | 1203 |
| CD3_SP11AVH3_VLK_3_Y_PTM | GFTFSKNG | 1167 | YYDSSK | 1148 | ASYWWDLDFDH | 1202 |
| CD3_SP11AVH3_VLK_3_S_PTM | GFTFSKNG | 1167 | YYDSSK | 1148 | ASSWWDLDFDH | 1203 |
| CD3_SP11AVH3_VLK_3_Y_SW | GFTFSKNG | 1167 | YYDSSK | 1148 | ASYSWDLDFDH | 1196 |
| CD3_SP11AVH3_VLK_3_S_SW | GFTFSKNG | 1167 | YYDSSK | 1148 | ASSSWDLDFDH | 1197 |
| CD3_SP11AVH3_VLK_3_Y_PTM_SW | GFTFSKNG | 1167 | YYDSSK | 1148 | ASYSWDLDFDH | 1196 |
| CD3_SP11AVH3_VLK_3_S_SWPTM | GFTFSKNG | 1167 | YYDSSK | 1148 | ASSSWDLDFDH | 1197 |
| CD3_SP11AVH3_VLK_SWPTM | GFTFSKNG | 1167 | YYDSSK | 1148 | ASFSWDLDFDH | 1185 |

TABLE AI-1-continued

CD3 Binders- Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11AVH3_VLK_3_SW | GFTFSKNG | 1167 | YYDSSK | 1148 | ASFSWDLDFDH | 1185 |
| CD3_sp11a_VH1_VK2_Y | GFTFSKQG | 1169 | YYDSSK | 1148 | ASYWWDLDFDH | 1202 |
| CD3_sp11a_VH1_VK2_S | GFTFSKQG | 1169 | YYDSSK | 1148 | ASSWWDLDFDH | 1203 |
| CD3_sp11a_VH1_VK2_Y_PTM | GFTFSKNG | 1167 | YYDSSK | 1148 | ASYWWDLDFDH | 1202 |
| CD3_sp11a_VH1_VK2_S_PTM | GFTFSKNG | 1167 | YYDSSK | 1148 | ASSWWDLDFDH | 1203 |
| CD3_sp11a_VH1_VK2_Y_SW | GFTFSKQG | 1169 | YYDSSK | 1148 | ASYSWDLDFDH | 1196 |
| CD3_sp11a_VH1_VK2_S_SW | GFTFSKQG | 1169 | YYDSSK | 1148 | ASSSWDLDFDH | 1197 |
| CD3_sp11a_VH1_VK2_Y_PTM | GFTFSKNG | 1167 | YYDSSK | 1148 | ASYSWDLDFDH | 1196 |
| CD3_sp11a_VH1_VK2_S_PTM_SW | GFTFSKNG | 1167 | YYDSSK | 1148 | ASSSWDLDFDH | 1197 |
| CD3_sp11a_VH1_VK2_SW | GFTFSKQG | 1169 | YYDSSK | 1148 | ASFSWDLDFDH | 1185 |
| CD3_sp11a_VH1_VK2_SW_PTM | GFTFSKNG | 1167 | YYDSSK | 1148 | ASFSWDLDFDH | 1185 |
| CD3_SP11A_VH3_VLK1_Y | GFTFSKNG | 1167 | YYDSSK | 1148 | ASYWWDLDFDH | 1202 |
| CD3_SP11A_VH3_VLK1_S | GFTFSKNG | 1167 | YYDSSK | 1148 | ASSWWDLDFDH | 1203 |
| CD3_SP11A_VH3_VLK1_Y_PTM | GFTFSKQG | 1169 | YYDSSK | 1148 | ASYWWDLDFDH | 1202 |
| CD3_SP11A_VH3_VLK1_S_PTM | GFTFSKQG | 1169 | YYDSSK | 1148 | ASSWWDLDFDH | 1203 |
| CD3_SP11A_VH3_VLK1_Y_SW | GFTFSKNG | 1167 | YYDSSK | 1148 | ASYSWDLDFDH | 1196 |
| CD3_SP11A_VH3_VLK1_S_SW | GFTFSKNG | 1167 | YYDSSK | 1148 | ASSSWDLDFDH | 1197 |
| CD3_SP11A_VH3_VLK1_Y_PTM | GFTFSKQG | 1169 | YYDSSK | 1148 | ASYWWDLDFDH | 1202 |
| CD3_SP11A_VH3_VLK1_S_PTM_SW | GFTFSKQG | 1169 | YYDSSK | 1148 | ASSSWDLDFDH | 1197 |
| CD3_SP11A_VH3_VLK1PTM_SW | GFTFSKQG | 1169 | YYDSSK | 1148 | ASFSWDLDFDH | 1185 |
| CD3_SP11A_VH3_VLK1_SW | GFTFSKNG | 1167 | YYDSSK | 1148 | ASFSWDLDFDH | 1185 |
| CD3_SP11A_VH5_VK2_Y | GFTFSKQG | 1169 | YYDSSK | 1148 | ASYWWDLDFDH | 1202 |
| CD3_SP11A_VH5_VK2_S | GFTFSKQG | 1169 | YYDSSK | 1148 | ASSWWDLDFDH | 1203 |
| CD3_SP11A_VH5_VK2_Y_PTM | GFTFSKNG | 1167 | YYDSSK | 1148 | ASYWWDLDFDH | 1202 |

TABLE AI-1-continued

CD3 Binders- Heavy Chain CDR sequences according to combination of Chothia and IMGT numbering schemes

| Binder | CDR-H1 | SEQ ID NO: | CDR-H2 | SEQ ID NO: | CDR-H3 | SEQ ID NO: |
|---|---|---|---|---|---|---|
| CD3_SP11A_VH5_VK2_S_PTM | GFTFSKNG | 1167 | YYDSSK | 1148 | ASSWWDLDFDH | 1203 |
| CD3_SP11A_VH5_VK2_Y_SW | GFTFSKQG | 1169 | YYDSSK | 1148 | ASYWDLDFDH | 1196 |
| CD3_SP11A_VH5_VK2_S_SW | GFTFSKQG | 1169 | YYDSSK | 1148 | ASSWDLDFDH | 1197 |
| CD3_SP11A_VH5_VK2_Y_PTM_SW | GFTFSKNG | 1167 | YYDSSK | 1148 | ASYWDLDFDH | 1196 |
| CD3_SP11A_VH5_VK2_S_PTM_SW | GFTFSKNG | 1167 | YYDSSK | 1148 | ASSWDLDFDH | 1197 |
| CD3_SP11A_VH5_VK2_PTM_SW | GFTFSKNG | 1167 | YYDSSK | 1148 | ASFWDLDFDH | 1185 |
| CD3_SP11A_VH5_VK2_SW | GFTFSKQG | 1169 | YYDSSK | 1148 | ASFWDLDFDH | 1185 |

TABLE AI-2

CD3 Binders- Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| NOV292 | SQSLVRSDGTTY | 1152 | RVS | 1084 | LQSSHFPWT | 1139 |
| NOV123 | SQSLIYSIGNTY | 1153 | RVS | 1084 | FQSTHLPYT | 1085 |
| Sp10b | SQSLIYSIGNTY | 1153 | RVS | 1084 | FQSTHLPYT | 1085 |
| NOV453 | SQNINNY | 1154 | NTDHLQAGVP | 1212 | LQHRSRYT | 1140 |
| NOV229 | SQNINNY | 1154 | NTDHLQAGVP | 1212 | LQHRSRYT | 1140 |
| NOV110 | SQSLVYSHGNTY | 1155 | RVS | 1084 | FQSTHLPYT | 1085 |
| NOV832 | SQSLVYSHGNTY | 1155 | RVS | 1084 | FQSTHLPYT | 1085 |
| NOV589 | SQSLVRSDGTTY | 1152 | RVS | 1084 | LQSSHFPWT | 1139 |
| NOV580 | SQNIDKY | 1156 | NTNNLEAGVP | 1213 | LQHRSSYT | 1141 |
| NOV567 | SQSIGNS | 1157 | STSTLEYGVP | 1214 | LQYATYPYT | 1142 |
| NOV221 | SQNIDKY | 1156 | NTNNLEAGVP | 1213 | LQHRSGYT | 1143 |
| CD3_sp11a_bkm1 | SQSLVRSDGTTY | 1152 | RVS | 1084 | LQSSHFPWT | 1139 |
| CD3_SP11a_bkm2 | SQSLVRSDGTTY | 1152 | RVS | 1084 | LQSSHFPWT | 1139 |
| CD3_sp11a_hz0 | SQSLVRSDGTTY | 1152 | RVS | 1084 | LQSSHFPWT | 1139 |

TABLE AI-2-continued

CD3 Binders- Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_HZ1 | SQSLVRSDGTTY | 1152 | RVS | 1084 | LQSSHFPW | 1220 |
| CD3_sp11a_sansPTM_hz1 | SQSLVRSEGTTY | 1158 | RVS | 1084 | LQSSHFPWT | 1139 |
| CD3_sp11a_sansPTM_rat | SQSLVRSEGTTY | 1158 | RVS | 1084 | LQSSHFPWT | 1139 |
| CD3_sp11a_VHVL_YY | SQSLVRSDGTTY | 1152 | RVS | 1084 | LQSSHFPWT | 1139 |
| CD3_SP11A_VHVL_SS | SQSLVRSDGTTY | 1152 | RVS | 1084 | LQSSHFPWT | 1139 |
| CD3_SP11A_VHVL_WS | SQSLVRSDGTTY | 1152 | RVS | 1084 | LQSSHFPWT | 1139 |
| CD3_sp11a_VHVL_SW | SQSLVRSDGTTY | 1152 | RVS | 1084 | LQSSHFPWT | 1139 |
| CD3_SP11A_VHVL_TT | SQSLVRSDGTTY | 1152 | RVS | 1084 | LQSSHFPWT | 1139 |
| CD3_SP11A_VHVL_TW | SQSLVRSDGTTY | 1152 | RVS | 1084 | LQSSHFPWT | 1139 |
| CD3_SP11A_VHVL_WT | SQSLVRSDGTTY | 1152 | RVS | 1084 | LQSSHFPWT | 1139 |
| CD3_SP11A_VH3_VLK_3 | SQSLVRSEGTTY | 1158 | RVS | 1084 | LQSSHFPWT | 1139 |
| CD3_sp11a_VH1_VK2 | SQSLVRSDGTTY | 1152 | RVS | 1084 | LQSSHFPWT | 1139 |
| CD3_SP11A_VH3_VLK1 | SQSLVRSEGTTY | 1158 | RVS | 1084 | LQSSHFPWT | 1139 |
| CD3_SP11A_VH5_VK2 | SQSLVRSDGTTY | 1152 | RVS | 1084 | LQSSHFPWT | 1139 |
| CD3_sp9aFW1_VL_VH_S56G | SQNINNY | 1154 | NTDHLQAGVP | 1212 | LQHRSRYT | 1140 |
| CD3_SP9AFW4_VL_VH_S56G | SQNINNY | 1154 | NTDHLQAGVP | 1212 | LQHRSRYT | 1140 |
| CD3_sp9aFW1_VLVH | SQNINNY | 1154 | NTDHLQAGVP | 1212 | LQHRSRYT | 1140 |
| CD3_sp9aFW4_VLVH | SQNINNY | 1154 | NTDHLQAGVP | 1212 | LQHRSRYT | 1140 |
| CD3_sp9arabtor_VHVL | SQNINNY | 1154 | NTDHLQAGVP | 1212 | LQHRSRYT | 1140 |
| CD3_sp9arabtor_VLVH | SQNINNY | 1154 | NTDHLQAGVP | 1212 | LQHRSRYT | 1140 |
| CD3_SP11AVH3_VLK_3_Y | SQSLVRSEGTTY | 1158 | RVS | 1084 | LQSSHFPWT | 1139 |
| CD3_SP11AVH3_VLK_3_S | SQSLVRSEGTTY | 1158 | RVS | 1084 | LQSSHFPWT | 1139 |
| CD3_SP11AVH3_VLK_3_Y_PTM | SQSLVRSDGTTY | 1152 | RVS | 1084 | LQSSHFPWT | 1139 |
| CD3_SP11AVH3_VLK_3_S_PTM | SQSLVRSDGTTY | 1152 | RVS | 1084 | LQSSHFPWT | 1139 |

TABLE AI-2-continued

CD3 Binders- Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11AVH3_VLK_3_Y_SW | SQSLVRSEGTTY | 1158 | RVS | 1084 | LQSSHFPWT | 1139 |
| CD3_SP11AVH3_VLK_3_S_SW | SQSLVRSEGTTY | 1158 | RVS | 1084 | LQSSHFPWT | 1139 |
| CD3_SP11AVH3_VLK_3_Y_PTM_SW | SQSLVRSDGTTY | 1152 | RVS | 1084 | LQSSHFPWT | 1139 |
| CD3_SP11AVH3_VLK_3_S_SWPTM | SQSLVRSDGTTY | 1152 | RVS | 1084 | LQSSHFPWT | 1139 |
| CD3_SP11AVH3_VLK_SWPTM | SQSLVRSDGTTY | 1152 | RVS | 1084 | LQSSHFPWT | 1139 |
| CD3_SP11AVH3_VLK_3_SW | SQSLVRSEGTTY | 1158 | RVS | 1084 | LQSSHFPWT | 1139 |
| CD3_sp11a_VH1_VK2_Y | SQSLVRSDGTTY | 1152 | RVS | 1084 | LQSSHFPWT | 1139 |
| CD3_sp11a_VH1_VK2_S | SQSLVRSDGTTY | 1152 | RVS | 1084 | LQSSHFPWT | 1139 |
| CD3_sp11a_VH1_VK2_Y_PTM | SQSLVRSEGTTY | 1158 | RVS | 1084 | LQSSHFPWT | 1139 |
| CD3_sp11a_VH1_VK2_S_PTM | SQSLVRSEGTTY | 1158 | RVS | 1084 | LQSSHFPWT | 1139 |
| CD3_sp11a_VH1_VK2_Y_SW | SQSLVRSDGTTY | 1152 | RVS | 1084 | LQSSHFPWT | 1139 |
| CD3_sp11a_VH1_VK2_S_SW | SQSLVRSDGTTY | 1152 | RVS | 1084 | LQSSHFPWT | 1139 |
| CD3_sp11a_VH1_VK2_Y_PTM | SQSLVRSEGTTY | 1158 | RVS | 1084 | LQSSHFPWT | 1139 |
| CD3_sp11a_VH1_VK2_S_PTM_SW | SQSLVRSEGTTY | 1158 | RVS | 1084 | LQSSHFPWT | 1139 |
| CD3_sp11a_VH1_VK2_SW | SQSLVRSDGTTY | 1152 | RVS | 1084 | LQSSHFPWT | 1139 |
| CD3_sp11a_VH1_VK2_SW_PTM | SQSLVRSEGTTY | 1158 | RVS | 1084 | LQSSHFPWT | 1139 |
| CD3_SP11A_VH3_VLK1_Y | SQSLVRSEGTTY | 1158 | RVS | 1084 | LQSSHFPWT | 1139 |
| CD3_SP11A_VH3_VLK1_S | SQSLVRSEGTTY | 1158 | RVS | 1084 | LQSSHFPWT | 1139 |
| CD3_SP11A_VH3_VLK1_Y_PTM | SQSLVRSDGTTY | 1152 | RVS | 1084 | LQSSHFPWT | 1139 |
| CD3_SP11A_VH3_VLK1_S_PTM | SQSLVRSDGTTY | 1152 | RVS | 1084 | LQSSHFPWT | 1139 |
| CD3_SP11A_VH3_VLK1_Y_SW | SQSLVRSEGTTY | 1158 | RVS | 1084 | LQSSHFPWT | 1139 |
| CD3_SP11A_VH3_VLK1_S_SW | SQSLVRSEGTTY | 1158 | RVS | 1084 | LQSSHFPWT | 1139 |
| CD3_SP11A_VH3_VLK1_Y_PTM | SQSLVRSDGTTY | 1152 | RVS | 1084 | LQSSHFPWT | 1139 |
| CD3_SP11A_VH3_VLK1_S_PTM_SW | SQSLVRSDGTTY | 1152 | RVS | 1084 | LQSSHFPWT | 1139 |

TABLE AI-2-continued

CD3 Binders- Light Chain CDR sequences according to combination of Chothia and IMGT numbering schemes

| Binder | CDR-L1 | SEQ ID NO: | CDR-L2 | SEQ ID NO: | CDR-L3 | SEQ ID NO: |
|---|---|---|---|---|---|---|
| CD3_SP11A_VH3_VLK1PTM_SW | SQSLVRSDGTTY | 1152 | RVS | 1084 | LQSSHFPWT | 1139 |
| CD3_SP11A_VH3_VLK1_SW | SQSLVRSEGTTY | 1158 | RVS | 1084 | LQSSHFPWT | 1139 |
| CD3_SP11A_VH5_VK2_Y | SQSLVRSDGTTY | 1152 | RVS | 1084 | LQSSHFPWT | 1139 |
| CD3_SP11A_VH5_VK2_S | SQSLVRSDGTTY | 1152 | RVS | 1084 | LQSSHFPWT | 1139 |
| CD3_SP11A_VH5_VK2_Y_PTM | SQSLVRSDGTTY | 1152 | RVS | 1084 | LQSSHFPWT | 1139 |
| CD3_SP11A_VH5_VK2_S_PTM | SQSLVRSDGTTY | 1152 | RVS | 1084 | LQSSHFPWT | 1139 |
| CD3_SP11A_VH5_VK2_Y_SW | SQSLVRSDGTTY | 1152 | RVS | 1084 | LQSSHFPWT | 1139 |
| CD3_SP11A_VH5_VK2_S_SW | SQSLVRSDGTTY | 1152 | RVS | 1084 | LQSSHFPWT | 1139 |
| CD3_SP11A_VH5_VK2_Y_PTM_SW | SQSLVRSDGTTY | 1152 | RVS | 1084 | LQSSHFPWT | 1139 |
| CD3_SP11A_VH5_VK2_S_PTM_SW | SQSLVRSDGTTY | 1152 | RVS | 1084 | LQSSHFPWT | 1139 |
| CD3_SP11A_VH5_VK2_PTM_SW | SQSLVRSDGTTY | 1152 | RVS | 1084 | LQSSHFPWT | 1139 |
| CD3_SP11A_VH5_VK2_SW | SQSLVRSDGTTY | 1152 | RVS | 1084 | LQSSHFPWT | 1139 |

TABLE AJ-1

CD3 Binders - Heavy chain variable sequences

| Binder | Sequence | SEQ ID NO: |
|---|---|---|
| NOV292 | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWWDLDFDHWGQGTMVTVSS | 1221 |
| NOV123 | QVQLVQSGAEVKKPGASVKVSCKASGYTFTSYYIYWVRQAPGQRLEWMGYIYPGHDAIYYSENFKGRVTITADTSASTAYMELSSLRSEDTAVYYCVRPNTMMAPLAYWGQGTLVTVSS | 1222 |
| Sp10b | QVQLHQSGAELAKPGTSVNLSCKASGYTFTSYYIYWIKRRPGQGLEWIGYIYPGHDAIYYSENFKGKATFTADTSSSTAYMLLGSLTPEDSAYYFCVRPNTMMAPLAYWGQGTLVTVSS | 1223 |
| NOV453 | QVQLQESGPGLVKPSETLSLTCTVSGFSLTTYNVHWIRQPPGKGLEWIGRMRYSGDTSFNAALTSRVTISRDTSKNQVSLKLSSVTAADTAVYYCTSDPMYIPNYSYGVMNAWGQGTTVTVSS | 1224 |
| NOV229 | QVQLQESGPGLVKPSETLSLTCTVSGFSLTTYNVHWIRQPPGKGLEWIGRMRYSGDTSFNAALTSRVTISVDTSKNQFSLKLSSVTAADTAVYYCARDPMYIPNYSYGVMNAWGQGTTVTVSS | 1225 |
| NOV110 | QVQLVQSGAEVKKPGASVKVSCKASGYTFTSYYIYWVRQAPGQRLEWMGYIYPANGGIYYSEKFKGRVTITADTSAGTAYMELSSLRSEDTAVYYCARPVTMMAPLVFWGQGTLVTVSS | 1226 |
| NOV832 | QVQLVQSGAEVKKPGASVKVSCKASGYTFTSYYIYWVRQAPGQRLEWMGYIYPANGGIYYSEKFKGRVTITRDTSASTAYMELSSLRSEDTAVYYCARPVTMMAPLVFWGQGTLVTVSS | 1227 |

TABLE AJ-1-continued

CD3 Binders - Heavy chain variable sequences

| Binder | Sequence | SEQ ID NO: |
|---|---|---|
| NOV589 | QVQLVESGGGVVQPGRSLRLSCAASGFTFSKNGMHWVRQA PGKGLEWVAMIYYDSSRMYYADTVKGRFTISRDNSKNTLYLQ MNSLRAEDTAVYYCASFWWDLDFDYWGQGTMVTVSS | 1228 |
| NOV580 | QVQLQESGPGLVKPSETLSLTCTVSGFSLTTYNIHWIRQPPGK GLEWIGRMRYSGDTSYSSALKSRVTISRDTSKNQVSLKLSSVT AADTAVYYCTRDPMYIPGYSYGVMNAWGQGTTVTVSS | 1229 |
| NOV567 | QVQLVESGGGVVQPGRSLRLSCAASGFAFRKYGMSWVRQA PGKGLEWVALIYYDSSKMNYADTVKGRFTISRDNSKNTLYLQ MNSLRAEDTAVYYCAALNSEYDWGQGTMVTVSS | 1230 |
| NOV221 | QVQLQESGPGLVKPSETLSLTCTVSGFSLTTYNIHWIRQPPGK GLEWIGRMRYSGDTSYSSALKSRVTISRDTSKNQVSLKLSSVT AADTAVYYCTRDPMYIPGYSYGVMNAWGQGTTVTVSS | 1229 |
| CD3_sp11a_bkm1 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWWDLDFDHWGQGTMVTVSS | 1221 |
| CD3_SP11a_bkm2 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCAKFWWDLDFDHWGQGTMVTVSS | 1231 |
| CD3_sp11a_hz0 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCAKFWWDLDFDHWGQGTMVTVSS | 1231 |
| CD3_SP11A_HZ1 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWWDLDFDHWGQGTMVTVSS | 1221 |
| CD3_sp11a_sansPTM_hz1 | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFWWDLDFDHWGQGTMVTVSS | 1232 |
| CD3_sp11a_sansPTM_rat | EVKLVESGGDLVQPGDSLTLSCVASGFTFSKQGMHWIRQAPK KGLEWIAMIYYDSSKMYYADTVKGRFTISRDNSKNTLYLEMNS LRSEDTAMYYCASFWWDLDFDHWGQGVMVTVSS | 1233 |
| CD3_sp11a_VHVL_YY | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFYYDLDFDHWGQGTMVTVSS | 1234 |
| CD3_SP11A_VHVL_SS | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSSDLDFDHWGQGTMVTVSS | 1235 |
| CD3_SP11A_VHVL_WS | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWSDLDFDHWGQGTMVTVSS | 1236 |
| CD3_sp11a_VHVL_SW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFSWDLDFDHWGQGTMVTVSS | 1237 |
| CD3_SP11A_VHVL_TT | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFTTDLDFDHWGQGTMVTVSS | 1238 |
| CD3_SP11A_VHVL_TW | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFTWDLDFDHWGQGTMVTVSS | 1239 |
| CD3_SP11A_VHVL_WT | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWTDLDFDHWGQGTMVTVSS | 1240 |
| CD3_SP11A VH3_VLK_3 | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASFWWDLDFDHWGQGTMVTVSS | 1221 |

TABLE AJ-1-continued

CD3 Binders - Heavy chain variable sequences

| Binder | Sequence | SEQ ID NO: |
|---|---|---|
| CD3_sp11a_VH1_VK2 | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFWWDLDFDHWGQGTMVTVSS | 1241 |
| CD3_SP11A_VH3_VLK1 | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWWDLDFDHWGQGTMVTVSS | 1221 |
| CD3_SP11A_VH5_VK2 | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFWWDLDFDHWGQGTMVTVSS | 1242 |
| CD3_sp9aFW1_VL_VH_S56G | EVQLVESGGGLVQPGGSLRLSCAASGFSLTTYNVHWVRQAPGKGLEWVGRMRYSGDTSFNAALTSRFTISRDNSKNTLYLQMNSLRAEDTAVYYCASDPMYIPNYAYGVMNAWGQGTLVTVSS | 1243 |
| CD3_SP9AFW4_VL_VH_S56G | EVQLVETGGGLVQPGGSRRLSCAASGFSLTTYNVHWVRQAPGKGLEWVGRMRYSGDTSFNAALTSRFTISRDTSKNTVYLQMNSLRAEDTGVYYCASDPMYIPNYAYGVMNAWGQGTLVTVSS | 1244 |
| CD3_sp9aFW1_VLVH | EVQLVETGGGLVQPGGSRRLSCAASGFSLTTYNVHWVRQAPGKGLEWVSRMRYSGDTSFNAALTSRFTISRDTSKNTVYLQMNSLRAEDTGVYYCASDPMYIPNYAYGVMNAWGQGTLVTVSS | 1245 |
| CD3_sp9aFW4_VLVH | VQLVESGGGLVQPGGSLRLSCAASGFSLTTYNVHWVRQAPGKGLEWVSRMRYSGDTSFNAALTSRFTISRDNSKNTLYLQMNSLRAEDTAVYYCASDPMYIPNYAYGVMNAWGQGTLVTVSS | 1246 |
| CD3_sp9arabtor_VHVL | EVQLVESGGGSVQPGGSLRLSCTASGFSLTTYNVHWVRQAPGKGLEWVGRMRYSGDTSFNAALTSRFTISRDNSKNTVYLQMNSLRAEDTATYYCASDPMYIPNYAYGVMNAWGQGTTVTVSS | 1247 |
| CD3_sp9arabtor_VLVH | EVQLVESGGGSVQPGGSLRLSCTASGFSLTTYNVHWVRQAPGKGLEWVGRMRYSGDTSFNAALTSRFTISRDNSKNTVYLQMNSLRAEDTATYYCASDPMYIPNYAYGVMNAWGQGTTVTVSS | 1247 |
| CD3_sp11a_VHVL_YY_SANSPTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFYYDLDFDHWGQGTMVTVSS | 1248 |
| CD3_sp11a_VHVL_YY_SANSPTM_Y | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYYYDLDFDHWGQGTMVTVSS | 1249 |
| CD3_sp11a_VHVL_YY_SANSPTM_S | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSYYDLDFDHWGQGTMVTVSS | 1250 |
| CD3_sp11a_VHVL_YY_Y | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCAS Y YYDLDFDHWGQGTMVTVSS | 1251 |
| CD3_sp11a_VHVL_YY_s | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSYYDLDFDHWGQGTMVTVSS | 1252 |
| CD3_sp11a_VHVL_SS_SANSPTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSSDLDFDHWGQGTMVTVSS | 1253 |
| CD3_sp11a_VHVL_SS_SANSPTM_Y | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYSSDLDFDHWGQGTMVTVSS | 1254 |
| CD3_sp11a_VHVL_SS_SANSPTM_S | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSSDLDFDHWGQGTMVTVSS | 1255 |
| CD3_sp11a_VHVL_SS_Y | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCAS Y SSDLDFDHWGQGTMVTVSS | 1256 |

TABLE AJ-1-continued

CD3 Binders - Heavy chain variable sequences

| Binder | Sequence | SEQ ID NO: |
|---|---|---|
| CD3_sp11a_VHVL_SS_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSSDLDFDHWGQGTMVTVSS | 1257 |
| CD3_sp11a_VHVL_SS_SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSSDLDFDHWGQGTMVTVSS | 1253 |
| CD3_sp11a_VHVL_WS_SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYWSDLDFDHWGQGTMVTVSS | 1258 |
| CD3_sp11a_VHVL_WS_SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSWSDLDFDHWGQGTMVTVSS | 1259 |
| CD3_sp11a_VHVL_WS_Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYWSDLDFDHWGQGTMVTVSS | 1260 |
| CD3_sp11a_VHVL_WS_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCAS S WS DLDFDHWGQGTMVTVSS | 1261 |
| CD3_sp11a_VHVL_WS_SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFWSDLDFDHWGQGTMVTVSS | 1262 |
| CD3_sp11a_VHVL_SW_SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYSWDLDFDHWGQGTMVTVSS | 1263 |
| CD3_sp11a_VHVL_SW_SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSSWDLDFDHWGQGTMVTVSS | 1264 |
| CD3_sp11a_VHVL_SW_Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYSWDLDFDHWGQGTMVTVSS | 1265 |
| CD3_sp11a_VHVL_SW_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSSWDLDFDHWGQGTMVTVSS | 1266 |
| CD3_sp11a_VHVL_SW_SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFSWDLDFDHWGQGTMVTVSS | 1267 |
| CD3_sp11a_VHVL_TW_SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYTWDLDFDHWGQGTMVTVSS | 1268 |
| CD3_sp11a_VHVL_TW_SANSPTM_S | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASSTWDLDFDHWGQGTMVTVSS | 1269 |
| CD3_sp11a_VHVL_TW_Y | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASYTWDLDFDHWGQGTMVTVSS | 1270 |
| CD3_sp11a_VHVL_TW_S | QVQLVESGGGVVQPGRSLRLSCAASGFTFSKNGMHWVRQA PGKGLEWVAMIYYDSSKMYYADTVKGRFTISRDNSKNTLYLQ MNSLRAEDTAVYYCASSTWDLDFDHWGQGTMVTVSS | 1271 |
| CD3_sp11a_VHVL_W_SANSPTM | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASFTWDLDFDHWGQGTMVTVSS | 1272 |
| CD3_sp11a_VHVL_TT_SANSPTM_Y | QVQLVESGGGVVQPGRSLRLSCAASGFTFSKQGMHWVRQA PGKGLEWVAMIYYDSSKMYYADTVKGRFTISRDNSKNTLYLQ MNSLRAEDTAVYYCASYTTDLDFDHWGQGTMVTVSS | 1273 |

TABLE AJ-1-continued

CD3 Binders - Heavy chain variable sequences

| Binder | Sequence | SEQ ID NO: |
|---|---|---|
| CD3_sp11a_VHVL_TT_SANSPTM_S | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSTTDLDFDHWGQGTMVTVSS | 1274 |
| CD3_sp11a_VHVL_TT_Y | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYTTDLDFDHWGQGTMVTVSS | 1275 |
| CD3_sp11a_VHVL_TT_S | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSTTDLDFDHWGQGTMVTVSS | 1276 |
| CD3_sp11a_VHVL_TT_SANSPTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFTTDLDFDHWGQGTMVTVSS | 1277 |
| CD3_SP11AVH3_VLK_3_Y | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWWDLDFDHWGQGTMVTVSS | 1278 |
| CD3_SP11AVH3_VLK_3_S | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS | 1279 |
| CD3_SP11AVH3_VLK_3_Y_PTM | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWWDLDFDHWGQGTMVTVSS | 1278 |
| CD3_SP11AVH3_VLK_3_S_PTM | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS | 1279 |
| CD3_SP11AVH3_VLK_3_Y_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSWDLDFDHWGQGTMVTVSS | 1265 |
| CD3_SP11AVH3_VLK_3_S_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSWDLDFDHWGQGTMVTVSS | 1266 |
| CD3_SP11AVH3_VLK_3_Y_PTM_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSWDLDFDHWGQGTMVTVSS | 1265 |
| CD3_SP11AVH3_VLK_3_S_SWPTM | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSWDLDFDHWGQGTMVTVSS | 1266 |
| CD3_SP11AVH3_VLK_SWPTM | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSWDLDFDHWGQGTMVTVSS | 1237 |
| CD3_SP11AVH3_VLK_3_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSWDLDFDHWGQGTMVTVSS | 1237 |
| CD3_sp11a_VH1_VK2_Y | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYWWDLDFDHWGQGTMVTVSS | 1280 |
| CD3_sp11a_VH1_VK2_S | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSWWDLDFDHWGQGTMVTVSS | 1281 |
| CD3_sp11a_VH1_VK2_Y_PTM | QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYWWDLDFDHWGQGTMVTVSS | 1282 |
| CD3_sp11a_VH1_VK2_S_PTM | QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSWWDLDFDHWGQGTMVTVSS | 1283 |

TABLE AJ-1-continued

CD3 Binders - Heavy chain variable sequences

| Binder | Sequence | SEQ ID NO: |
|---|---|---|
| CD3_sp11a_VH1_VK2_Y_SW | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYSWDLDFDHWGQGTMVTVSS | 1284 |
| CD3_sp11a_VH1_VK2_S_SW | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSSWDLDFDHWGQGTMVTVSS | 1285 |
| CD3_sp11a_VH1_VK2_Y_PTM | QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYSWDLDFDHWGQGTMVTVSS | 1286 |
| CD3_sp11a_VH1_VK2_S_PTM_SW | QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSSWDLDFDHWGQGTMVTVSS | 1287 |
| CD3_sp11a_VH1_VK2_SW | QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFSWDLDFDHWGQGTMVTVSS | 1288 |
| CD3_sp11a_VH1_VK2_SW_PTM | QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASFSWDLDFDHWGQGTMVTVSS | 1289 |
| CD3_SP11A_VH3_VLK1_Y | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWWDLDFDHWGQGTMVTVSS | 1278 |
| CD3_SP11A_VH3_VLK1_S | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS | 1279 |
| CD3_SP11A_VH3_VLK1_Y_PTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWWDLDFDHWGQGTMVTVSS | 1290 |
| CD3_SP11A_VH3_VLK1_S_PTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSWWDLDFDHWGQGTMVTVSS | 1291 |
| CD3_SP11A_VH3_VLK1_Y_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSWDLDFDHWGQGTMVTVSS | 1265 |
| CD3_SP11A_VH3_VLK1_S_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS | 1279 |
| CD3_SP11A_VH3_VLK1_Y_PTM | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWWDLDFDHWGQGTMVTVSS | 1290 |
| CD3_SP11A_VH3_VLK1_S_PTM_SW | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSWDLDFDHWGQGTMVTVSS | 1264 |
| CD3_SP11A_VH3_VLK1_PTM_SW | QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSWDLDFDHWGQGTMVTVSS | 1267 |
| CD3_SP11A_VH3_VLK1_SW | QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSWDLDFDHWGQGTMVTVSS | 1237 |
| CD3_SP11A_VH5_VK2_Y | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYWWDLDFDHWGQGTMVTVSS | 1292 |
| CD3_SP11A_VH5_VK2_S | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSWWDLDFDHWGQGTMVTVSS | 1293 |

TABLE AJ-1-continued

CD3 Binders - Heavy chain variable sequences

| Binder | Sequence | SEQ ID NO: |
|---|---|---|
| CD3_SP11A_VH5_VK2_Y_PTM | EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYWWDLDFDHWGQGTMVTVSS | 1294 |
| CD3_SP11A_VH5_VK2_S_PTM | EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSWWDLDFDHWGQGTMVTVSS | 1295 |
| CD3_SP11A_VH5_VK2_Y_SW | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYSWDLDFDHWGQGTMVTVSS | 1296 |
| CD3_SP11A_VH5_VK2_S_SW | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSSWDLDFDHWGQGTMVTVSS | 1297 |
| CD3_SP11A_VH5_VK2_Y_PTM_SW | EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYSWDLDFDHWGQGTMVTVSS | 1298 |
| CD3_SP11A_VH5_VK2_S_PTM_SW | EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSSWDLDFDHWGQGTMVTVSS | 1299 |
| CD3_SP11A_VH5_VK2_PTM_SW | EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASFSWDLDFDHWGQGTMVTVSS | 1300 |
| CD3_SP11A_VH5_VK2_SW | EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFSWDLDFDHWGQGTMVTVSS | 1301 |
| NOV292 | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| NOV123 | DVVMTQSPLSLPVTLGQPASISCRSSQSLIYSIGNTYLHWYQQRPGQSPRLLIYRVSNRFSGVPDRFSGSGSGTDFTLKISRVEAEDVGVYYCFQSTHLPYTFGQGTKLEIK | 1303 |
| Sp10b | VVVLTQTPVSLPVSLGGQASISCRSSQSLIYSIGNTYLHWYLQKPGQSPQLLIYRVSNRFSGVPDRFSGSGSGTDFTLKISRVEPEDLGDYYCFQSTHLPYTFGAGTKLELK | 1304 |
| NOV453 | DIQMTQSPSSLSASVGDRVTITCKASQNINNYLNWYQQKPGKAPKLLIYNTDHLQAGVPSRFSGSGSGTDYTLTISSLQPEDFATYFCLQHRSRYTFGPGTKVDIK | 1305 |
| NOV229 | DIQMTQSPSSLSASVGDRVTITCKASQNINNYLNWYQQKPGKAPKLLIYNTDHLQAGVPSRFSGSGSGTDFTLTISSLQPEDFATYYCLQHRSRYTFGPGTKVDIK | 1306 |
| NOV110 | DVVMTQSPLSLPVTLGQPASISCRSSQSLVYSHGNTYLHWYQQRPGQSPRLLIYRVSNRFSGVPDRFSGSGSGTDFTLKISRVEAEDVGVYYCFQSTHLPYTFGQGTKLEIK | 1307 |
| NOV832 | DVVMTQSPLSLPVTLGQPASISCRSSQSLVYSHGNTYLHWFQQRPGQSPRRLIYRVSNRFSGVPDRFSGSGSGTDFTLKISRVEAEDVGVYYCFQSTHLPYTFGQGTKLEIK | 1308 |
| NOV589 | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| NOV580 | DIQMTQSPSSLSASVGDRVTITCKTSQNIDKYLNWYQQKPGKAPKLLIYNTNNLEAGVPSRFSGSGSGTDYTFTISSLQPEDIATYFCLQHRSSYTFGQGTKLEIK | 1309 |
| NOV567 | DIQMTQSPSSLSASVGDRVTITCRGSQSIGNSLNWYQQKPGKAPKRLIYSTSTLEYGVPSRFSGSGSGTEYTLTISSLQPEDFATYYCLQYATYPYTFGQGTKLEIK | 1310 |

TABLE AJ-1-continued

CD3 Binders - Heavy chain variable sequences

| Binder | Sequence | SEQ ID NO: |
|---|---|---|
| NOV221 | DIQMTQSPSSLSASVGDRVTITCKSSQNIDKYLNWYQQKPGK APKLLIYNTNNLEAGVPSRFSGSGSGTDYTFTISSLQPEDIATY FCLQHRSGYTFGQGTKLEIK | 1311 |
| CD3_sp11a_bkm1 | DIVMTQTPLSSPVTLGQPASISCRSSQSLVRSDGTTYFNWLQ QRPGQPPRLLIYRVSNRFSGVPDRFSGSGAGTDFTLKISRVEA EDVGVYYCLQSSHFPWTFGGGTKVEIK | 1312 |
| CD3_SP11a_bkm2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_sp11a_hz0 | DIVMTQTPLSSPVTLGQPASISCRSSQSLVRSDGTTYFNWLQ QRPGQPPRLLIYRVSNRFSGVPDRFSGSGAGTDFTLKISRVEA EDVGVYYCLQSSHFPWTFGGGTKVEIK | 1312 |
| CD3_SP11A_HZ1 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSH | 1313 |
| CD3_sp11a_sansPTM_hz1 | DIVMTQTPLSSPVTLGQPASISCRSSQSLVRSEGTTYFNWYQ QRPGQPPRLLIYRVSNRFSGVPDRFSGSGAGTDFTLKISRVEA EDVGVYYCLQSSHFPWTFGGGTKVEIK | 1314 |
| CD3_sp11a_sansPTM_rat | DILVTQTPVSLPVSLGGHVSISCRSSQSLVRSEGTTYFNWYLQ KPGQSPQLLIYRVSNRFSGVPDRFSGSGSGTDFTLKISRVEPE DLGVYYCLQSSHFPWTFGGGTKLELK | 1315 |
| CD3_sp11a_VHVL_YY | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VHVL_SS | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VHVL_WS | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_sp11a_VHVL_SW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VHVL_TT | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VHVL_TW | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VHVL_WT | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VH3_VLK_3 | EIVLTQSPGTLSLSPGERATLSCRSSQSLVRSEGTTYFNWYQ QKPGQAPRLLIYRVSNRFSGIPDRFSGSGSGTDFTLTISRLEPE DLAVYYCLQSSHFPWTFGGGTKVEIK | 1316 |
| CD3_sp11a_VH1_VK2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |
| CD3_SP11A_VH3_VLK1 | DIQMTQSPSSLSASVGDRVTITCRSSQSLVRSEGTTYFNWYQ QKPGKAPKLLIYRVSNRFSGVPSRFSGSGSGTDFTLTISSLQP EDFATYYCLQSSHFPWTFGGGTKVEIK | 1317 |
| CD3_SP11A_VH5_VK2 | DIVMTQTPLSSPVTLGQPASISCRSSQSLVRSDGTTYFNWYQ QRPGQPPRLLIYRVSNRFSGVPDRFSGSGAGTDFTLKISRVEA EDVGVYYCLQSSHFPWTFGGGTKVEIK | 1302 |

TABLE AJ-1-continued

CD3 Binders - Heavy chain variable sequences

| Binder | Sequence | SEQ ID NO: |
|---|---|---|
| CD3_sp9aFW1_VL_VH_S56G | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_SP9AFW4_VL_VH_S56G | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_sp9aFW1_VLVH | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_sp9aFW4_VLVH | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_sp9arabtor_VHVL | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_sp9arabtor_VLVH | EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL | 1318 |
| CD3_sp11a_VHVL_YY_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_YY_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_YY_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_YY_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_YY_s | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_SS_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SS_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SS_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SS_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_SS_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_SS_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_WS_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |

TABLE AJ-1-continued

CD3 Binders - Heavy chain variable sequences

| Binder | Sequence | SEQ ID NO: |
|---|---|---|
| CD3_sp11a_VHVL_WS_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_WS_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_WS_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_WS_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SW_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SW_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_SW_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_SW_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_SW_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TW_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TW_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TW_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_TW_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_TW_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TT_SANSPTM_Y | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TT_SANSPTM_S | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VHVL_TT_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VHVL_TT_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |

TABLE AJ-1-continued

CD3 Binders - Heavy chain variable sequences

| Binder | Sequence | SEQ ID NO: |
|---|---|---|
| CD3_sp11a_VHVL_TT_SANSPTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_SP11AVH3_VLK_3_Y | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 1316 |
| CD3_SP11AVH3_VLK_3_S | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 1316 |
| CD3_SP11AVH3_VLK_3_Y_PTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 1319 |
| CD3_SP11AVH3_VLK_3_S_PTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 1319 |
| CD3_SP11AVH3_VLK_3_Y_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 1316 |
| CD3_SP11AVH3_VLK_3_S_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 1316 |
| CD3_SP11AVH3_VLK_3_Y_PTM_SW_ | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 1319 |
| CD3_SP11AVH3_VLK_3_S_SWPTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 1319 |
| CD3_SP11AVH3_VLK_SWPTM | EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK | 1319 |
| CD3_SP11AVH3_VLK_3_SW | EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK | 1316 |
| CD3_sp11a_VH1_VK2_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VH1_VK2_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VH1_VK2_Y_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VH1_VK2_S_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VH1_VK2_Y_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VH1_VK2_S_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VH1_VK2_Y_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |

TABLE AJ-1-continued

CD3 Binders - Heavy chain variable sequences

| Binder | Sequence | SEQ ID NO: |
|---|---|---|
| CD3_sp11a_VH1_VK2_S_PTM_SW | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_sp11a_VH1_VK2_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_sp11a_VH1_VK2_SW_PTM | DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK | 1314 |
| CD3_SP11A_VH3_VLK1_Y | DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK | 1317 |
| CD3_SP11A_VH3_VLK1_S | DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK | 1317 |
| CD3_SP11A_VH3_VLK1_Y_PTM | DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK | 1320 |
| CD3_SP11A_VH3_VLK1_S_PTM | DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK | 1320 |
| CD3_SP11A_VH3_VLK1_Y_SW | DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK | 1317 |
| CD3_SP11A_VH3_VLK1_S_SW | DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK | 1317 |
| CD3_SP11A_VH3_VLK1_Y_PTM | DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK | 1320 |
| CD3_SP11A_VH3_VLK1_S_PTM_SW | DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK | 1320 |
| CD3_SP11A_VH3_VLK1_PTM_SW | DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK | 1320 |
| CD3_SP11A_VH3_VLK1_SW | DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK | 1317 |
| CD3_SP11A_VH5_VK2_Y | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_S | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_Y_PTM | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_S_PTM | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_Y_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |

TABLE AJ-1-continued

CD3 Binders - Heavy chain variable sequences

| Binder | Sequence | SEQ ID NO: |
|---|---|---|
| CD3_SP11A_VH5_VK2_S_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_Y_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_S_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_PTM_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |
| CD3_SP11A_VH5_VK2_SW | DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK | 1302 |

The group C1 CDR sequences in Table AA are based upon the Kabat CDR sequences, Chothia CDR sequences, IMGT CDR sequences, and combinations thereof, of the CD3 binding molecules NOV292, NOV589, NOV567, and the CD3 binding molecules which include "sp11a" in the binder name. The group C2 CDR sequences in Table AB are based upon the Kabat CDR sequences, Chothia CDR sequences, IMGT CDR sequences, and combinations thereof, of the CD3 binding molecules NOV453, NOV229, NOV580, NOV221, and the CD3 binding molecules which include "sp9a" in the binder name. The group C3 CDR sequences in Table AC are based upon the Kabat CDR sequences, Chothia CDR sequences, IMGT CDR sequences, and combinations thereof, of the CD3 binding molecules NOV123, sp10b, NOV110, and NOV832.

The specific CDR sequences of the CD3 binding molecules described in the Examples of WO 2020/052692 are listed in Table AB-1 to Table AH-2. VH and VL sequences described in WO 2020/052692 are listed in Table AJ-1 and Table AJ-2, respectively.

In some embodiments, a CD3 ABM can comprise a heavy chain CDR having an amino acid sequence of any one of the CDR consensus sequences listed in Table AA, Table AB, or Table AC. In particular embodiments, a CD3 ABM can comprise (or alternatively, consist of) one, two, three, or more heavy chain CDRs selected from the heavy chain CDRs described in Table AA, Table AB, or Table AC.

In some embodiments, a CD3 ABM can comprise a light chain CDR having an amino acid sequence of any one of the CDR consensus sequences listed in Table AA, Table AB, or Table AC. In particular embodiments, a CD3 ABM can comprise (or alternatively, consist of) one, two, three, or more light chain CDRs selected from the light chain CDRs described in Table AA, Table AB, or Table AC.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AA.

In some embodiments, the amino acid designated $X_1$ in Table AA is T. In some embodiments, the amino acid designated $X_1$ in Table AA is A. In some embodiments, the amino acid designated $X_2$ in Table AA is S. In some embodiments, the amino acid designated $X_2$ in Table AA is R. In some embodiments, the amino acid designated $X_3$ in Table AA is N. In some embodiments, the amino acid designated $X_3$ in Table AA is Y. In some embodiments, the amino acid designated $X_3$ in Table AA is Q. In some embodiments, the amino acid designated $X_4$ in Table AA is H. In some embodiments, the amino acid designated $X_4$ in Table AA is S. In some embodiments, the amino acid designated $X_5$ in Table AA is M. In some embodiments, the amino acid designated $X_5$ in Table AA is L. In some embodiments, the amino acid designated $X_6$ in Table AA is K. In some embodiments, the amino acid designated $X_6$ in Table AA is R. In some embodiments, the amino acid designated $X_7$ in Table AA is S. In some embodiments, the amino acid designated $X_7$ in Table AA is K. In some embodiments, the amino acid designated $X_{55}$ in Table AA is F. In some embodiments, the amino acid designated $X_{55}$ in Table AA is Y. In some embodiments, the amino acid designated $X_{55}$ in Table AA is S. In some embodiments, the amino acid designated $X_8$ in Table AA is W. In some embodiments, the amino acid designated $X_8$ in Table AA is Y. In some embodiments, the amino acid designated $X_8$ in Table AA is S. In some embodiments, the amino acid designated $X_8$ in Table AA is T. In some embodiments, the amino acid designated $X_9$ in Table AA is W. In some embodiments, the amino acid designated $X_9$ in Table AA is Y. In some embodiments, the amino acid designated $X_9$ in Table AA is S. In some embodiments, the amino acid designated $X_9$ in Table AA is T. In some embodiments, the amino acid designated $X_{10}$ in Table AA is H. In some embodiments, the amino acid designated $X_{10}$ in Table AA is Y. In some embodiments, the amino acid designated $X_{11}$ in Table AA is S. In some embodiments, the amino acid designated $X_{11}$ in Table AA is G. In some embodiments, the amino acid designated $X_{12}$ in Table AA is I. In some embodiments, the amino acid designated $X_{12}$ in Table AA is L. In some embodiments, the amino acid designated $X_{13}$ in Table AA is V. In some embodiments, the amino acid designated $X_{13}$ in Table AA is G. In some embodiments, the amino acid designated $X_{14}$ in Table AA is R. In some embodiments, the amino acid designated $X_{14}$ in Table AA is N. In some embodiments, the amino acid designated $X_{15}$ in Table AA is D. In some embodiments, the amino acid designated $X_{15}$ in Table AA is E. In some embodiments, the amino acid designated $X_{15}$ in Table AA is L. In some embodiments, the amino acid designated $X_{16}$ in Table AA is G. In some embodiments, the amino acid designated $X_{16}$ in Table AA is N. In some embodiments, the amino acid designated $X_{16}$ in Table AA is E. In some embodiments, the amino acid designated $X_{17}$ in Table AA is R. In some embodiments, the amino acid designated $X_{17}$ in Table AA is S. In some embodiments, the amino acid designated $X_{18}$ in Table AA is V. In some embodiments, the amino acid designated $X_{18}$ in Table AA is T. In some embodiments, the amino acid designated $X_{19}$ in Table AA is N. In some embodiments, the amino acid designated $X_{19}$ in Table AA is T. In some embodiments, the amino acid designated $X_{20}$ in Table AA is R. In some embodiments, the amino acid designated $X_{20}$ in Table AA is L. In some embodiments, the amino acid designated $X_{21}$ in Table AA is F. In some embodiments, the amino acid designated $X_{21}$ in Table AA is E. In some embodiments, the amino acid designated $X_{22}$ in Table AA is S. In some embodiments, the amino acid designated $X_{22}$ in Table AA is Y. In some embodiments, the amino acid designated $X_{23}$ in Table AA is S. In some embodiments, the amino acid designated $X_{23}$ in Table AA is Y. In some embodiments, the amino acid designated $X_{24}$ in Table AA is S. In some embodiments, the amino acid designated $X_{24}$ in Table AA is A. In some embodiments, the amino acid designated $X_{25}$ in Table AA is H. In some embodiments, the amino acid designated $X_{25}$ in Table AA is T. In some embodiments, the amino acid designated $X_{26}$ in Table AA is F. In some embodiments, the amino acid designated $X_{26}$ in Table AA is Y. In some embodiments, the amino acid designated $X_{27}$ in Table AA is W. In some embodiments, the amino acid designated $X_{27}$ in Table AA is Y.

In some embodiments, a CD3 ABM can comprise the CDR-H1 sequence C1-1. In some embodiments, a CD3 ABM can comprise the CDR-H1 sequence C1-2. In some embodiments, a CD3 ABM can comprise the CDR-H1 sequence C1-3. In some embodiments, a CD3 ABM can comprise the CDR-H1 sequence C1-4.

In some embodiments, a CD3 ABM can comprise the CDR-H2 sequence C1-5. In some embodiments, a CD3 ABM can comprise the CDR-H2 sequence C1-6. In some embodiments, a CD3 ABM can comprise the CDR-H2 sequence C1-7.

In some embodiments, a CD3 ABM can comprise the CDR-H3 sequence C1-8. In some embodiments, a CD3 ABM can comprise the CDR-H3 sequence C1-9. In some embodiments, a CD3 ABM can comprise the CDR-H3 sequence C1-10. In some embodiments, a CD3 ABM can comprise the CDR-H3 sequence C1-11.

In some embodiments, a CD3 ABM can comprise the CDR-L1 sequence C1-12. In some embodiments, a CD3 ABM can comprise the CDR-L1 sequence C1-13. In some embodiments, a CD3 ABM can comprise the CDR-L1 sequence C1-14. In some embodiments, a CD3 ABM can comprise the CDR-L1 sequence C1-15. In some embodiments, a CD3 ABM can comprise the CDR-L1 sequence C1-16. In some embodiments, a CD3 ABM can comprise the CDR-L1 sequence C1-17.

In some embodiments, a CD3 ABM can comprise the CDR-L2 sequence C1-18. In some embodiments, a CD3 ABM can comprise the CDR-L2 sequence C1-19.

In some embodiments, a CD3 ABM can comprise the CDR-L3 sequence C1-20. In some embodiments, a CD3 ABM can comprise the CDR-L3 sequence C1-21. In some embodiments, a CD3 ABM can comprise the CDR-L3 sequence C1-22. In some embodiments, a CD3 ABM can comprise the CDR-L3 sequence C1-23.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AB.

In some embodiments, the amino acid designated $X_{28}$ in Table AB is V. In some embodiments, the amino acid designated $X_{28}$ in Table AB is I. In some embodiments, the amino acid designated $X_{29}$ in Table AB is F. In some embodiments, the amino acid designated $X_{29}$ in Table AB is Y. In some embodiments, the amino acid designated $X_{30}$ in Table AB is N. In some embodiments, the amino acid designated $X_{30}$ in Table AB is S. In some embodiments, the amino acid designated $X_{31}$ in Table AB is A. In some embodiments, the amino acid designated $X_{31}$ in Table AB is S. In some embodiments, the amino acid designated $X_{32}$ in Table AB is T. In some embodiments, the amino acid designated $X_{32}$ in Table AB is K. In some embodiments, the amino acid designated $X_{33}$ in Table AB is T. In some embodiments, the amino acid designated $X_{33}$ in Table AB is A. In some embodiments, the amino acid designated $X_{34}$ in Table AB is S. In some embodiments, the amino acid designated $X_{34}$ in Table AB is R. In some embodiments, the amino acid designated $X_{35}$ in Table AB is N. In some embodiments, the amino acid designated $X_{35}$ in Table AB is G. In some embodiments, the amino acid designated $X_{36}$ in Table AB is S. In some embodiments, n the amino acid designated $X_{36}$ in Table AB is A. In some embodiments, the amino acid designated $X_{37}$ in Table AB is A. In some embodiments, the amino acid designated $X_{37}$ in Table AB is T. In some embodiments, the amino acid designated $X_{37}$ in Table AB is S. In some embodiments, the amino acid designated $X_{38}$ in Table AB is N. In some embodiments, the amino acid designated $X_{38}$ in Table AB is D. In some embodiments, the amino acid designated $X_{39}$ in Table AB is N. In some embodiments, the amino acid designated $X_{39}$ in Table AB is K. In some embodiments, the amino acid designated $X_{40}$ in Table AB is D. In some embodiments, the amino acid designated $X_{40}$ in Table AB is N. In some embodiments, the amino acid designated $X_{41}$ in Table AB is H. In some embodiments, the amino acid designated $X_{41}$ in Table AB is N. In some embodiments, the amino acid designated $X_{42}$ in Table AB is Q. In some embodiments, the amino acid designated $X_{42}$ in Table AB is E. In some embodiments, the amino acid designated $X_{43}$ in Table AB is R. In some embodiments, the amino acid designated $X_{43}$ in Table AB is S. In some embodiments, the amino acid designated $X_{43}$ in Table AB is G.

In some embodiments, a CD3 ABM can comprise the CDR-H1 sequence C2-1. In some embodiments, a CD3 ABM can comprise the CDR-H1 sequence C2-2. In some embodiments, a CD3 ABM can comprise the CDR-H1 sequence C2-3. In some embodiments, a CD3 ABM can comprise the CDR-H1 sequence C2-4.

In some embodiments, a CD3 ABM can comprise the CDR-H2 sequence C2-5. In some embodiments, a CD3 ABM can comprise the CDR-H2 sequence C2-6. In some embodiments, a CD3 ABM can comprise the CDR-H2 sequence C2-7.

In some embodiments, a CD3 ABM can comprise the CDR-H3 sequence C2-8. In some embodiments, a CD3 ABM can comprise the CDR-H3 sequence C2-9.

In some embodiments, a CD3 ABM can comprise the CDR-L1 sequence C2-10. In some embodiments, a CD3

ABM can comprise the CDR-L1 sequence C2-11. In some embodiments, a CD3 ABM can comprise the CDR-L1 sequence C2-12.

In some embodiments, a CD3 ABM can comprise the CDR-L2 sequence C2-13. In some embodiments, a CD3 ABM can comprise the CDR-L2 sequence C2-14. In some embodiments, a CD3 ABM can comprise the CDR-L2 sequence C2-15.

In some embodiments, a CD3 ABM can comprise the CDR-L3 sequence C2-16. In some embodiments, a CD3 ABM can comprise the CDR-L3 sequence C2-17.

In some embodiments, a CD3 ABM can comprise a CDR-H1 sequence, a CDR-H2 sequence a CDR-H3 sequence, a CDR-L1 sequence, a CDR-L2 sequence, and a CDR-L3 sequence set forth in Table AC.

In some embodiments, the amino acid designated $X_{44}$ in Table AC is G. In some embodiments, the amino acid designated $X_{44}$ in Table AC is A. In some embodiments, the amino acid designated $X_{45}$ in Table AC is H. In some embodiments, the amino acid designated $X_{45}$ in Table AC is N. In some embodiments, the amino acid designated $X_{46}$ in Table AC is D. In some embodiments, the amino acid designated $X_{46}$ in Table AC is G. In some embodiments, the amino acid designated $X_{47}$ in Table AC is A. In some embodiments, the amino acid designated $X_{47}$ in Table AC is G. In some embodiments, the amino acid designated $X_{48}$ in Table AC is N. In some embodiments, the amino acid designated $X_{48}$ in Table AC is K. In some embodiments, the amino acid designated $X_{49}$ in Table AC is V. In some embodiments, the amino acid designated $X_{49}$ in Table AC is A. In some embodiments, the amino acid designated $X_{50}$ in Table AC is N. In some embodiments, the amino acid designated $X_{50}$ in Table AC is V. In some embodiments, the amino acid designated $X_{51}$ in Table AC is A. In some embodiments, the amino acid designated $X_{51}$ in Table AC is V. In some embodiments, the amino acid designated $X_{52}$ in Table AC is Y. In some embodiments, the amino acid designated $X_{52}$ in Table AC is F. In some embodiments, the amino acid designated $X_{53}$ in Table AC is I. In some embodiments, the amino acid designated $X_{53}$ in Table AC is V. In some embodiments, the amino acid designated $X_{54}$ in Table AC is I. In some embodiments, the amino acid designated $X_{54}$ in Table AC is H.

In some embodiments, a CD3 ABM can comprise the CDR-H1 sequence C3-1. In some embodiments, a CD3 ABM can comprise the CDR-H1 sequence C3-2. In some embodiments, a CD3 ABM can comprise the CDR-H1 sequence C3-3. In some embodiments, a CD3 ABM can comprise the CDR-H1 sequence C3-4.

In some embodiments, a CD3 ABM can comprise the CDR-H2 sequence C3-5. In some embodiments, a CD3 ABM can comprise the CDR-H2 sequence C3-6. In some embodiments, a CD3 ABM can comprise the CDR-H2 sequence C3-7.

In some embodiments, a CD3 ABM can comprise the CDR-H3 sequence C3-8. In some embodiments, a CD3 ABM can comprise the CDR-H3 sequence C3-9.

In some embodiments, a CD3 ABM can comprise the CDR-L1 sequence C3-10. In some embodiments, a CD3 ABM can comprise the CDR-L1 sequence C3-11. In some embodiments, a CD3 ABM can comprise the CDR-L1 sequence C3-12.

In some embodiments, a CD3 ABM can comprise the CDR-L2 sequence C3-13. In some embodiments, a CD3 ABM can comprise the CDR-L2 sequence C3-14.

In some embodiments, a CD3 ABM can comprise the CDR-L3 sequence C3-15. In some embodiments, a CD3 ABM can comprise the CDR-L3 sequence C3-16.

In some embodiments, a CD3 ABM can comprise CDR-H1, CDR-H2, and CDR-H3 sequences set forth in Table AD-1 and the corresponding CDR-L1, CDR-L2, and CDR-L3 sequences set forth in Table AD-2.

In some embodiments, a CD3 ABM can comprise CDR-H1, CDR-H2, and CDR-H3 sequences set forth in Table AE-1 and the corresponding CDR-L1, CDR-L2, and CDR-L3 sequences set forth in Table AE-2.

In some embodiments, a CD3 ABM can comprise CDR-H1, CDR-H2, and CDR-H3 sequences set forth in Table AF-1 and the corresponding CDR-L1, CDR-L2, and CDR-L3 sequences set forth in Table AF-2.

In some embodiments, a CD3 ABM can comprise CDR-H1, CDR-H2, and CDR-H3 sequences set forth in Table AG-1 and the corresponding CDR-L1, CDR-L2, and CDR-L3 sequences set forth in Table AG-2.

In some embodiments, a CD3 ABM can comprise CDR-H1, CDR-H2, and CDR-H3 sequences set forth in Table AH-1 and the corresponding CDR-L1, CDR-L2, and CDR-L3 sequences set forth in Table AH-2.

In some embodiments, a CD3 ABM can comprise CDR-H1, CDR-H2, and CDR-H3 sequences set forth in Table AI-1 and the corresponding CDR-L1, CDR-L2, and CDR-L3 sequences set forth in Table AI-2.

In some embodiments, a CD3 ABM can comprise a heavy chain CDR having an amino acid sequence of any one of the CDRs listed in Table AB-1, Table AC-1, Table AD-1, Table AE-1, Table AF-1, Table AG-1, Table AH-1, or Table AI-1. In particular embodiments, a CD3 ABM can comprise (or alternatively, consist of) one, two, three, or more heavy chain CDRs selected the heavy chain CDRs described in Table AB-1, Table AC-1, Table AD-1, Table AE-1, Table AF-1, Table AG-1, Table AH-1, and Table AI-1.

In some embodiments, a CD3 ABM can comprise a light chain CDR having an amino acid sequence of any one of the CDRs listed in Table AB-2, Table AC-2, Table AD-2, Table AE-2, Table AF-2, Table AG-2, Table AH-2, or Table AI-2. In particular embodiments, a CD3 ABM can comprise (or alternatively, consist of) one, two, three, or more light chain CDRs selected the light chain CDRs described in Table AB-2, Table AC-2, Table AD-2, Table AE-2, Table AF-2, Table AG-2, Table AH-2, and Table AI-2.

Other CD3 ABMs include amino acids that have been mutated, yet have at least 80, 85, 90, 95, 96, 97, 98, or 99 percent identity in the CDR regions with the CDR sequences described in Table A. In some embodiments, such CD3 ABMs include mutant amino acid sequences where no more than 1, 2, 3, 4 or 5 amino acids have been mutated in the CDR regions when compared with the CDR sequences described in Table A.

In some embodiments, a CD3 ABM can comprise a VH and/or VL domain having an amino acid sequence of any VH and/or VL domain described in Table A. Other CD3 ABMs include VH and/or VL domains comprising amino acid sequences having at least 80, 85, 90, 95, 96, 97, 98, or 99 percent identity to the VH and/or VL sequences described in Table A. In some embodiments, CD3 ABMs include VH and/or VL domains where no more than 1, 2, 3, 4 or 5 amino acids have been mutated when compared with the VH and/or VL domains depicted in the sequences described in Table A, while retaining substantially the same therapeutic activity.

VH and VL sequences (amino acid sequences and the nucleotide sequences encoding the amino acid sequences) can be "mixed and matched" to create other CD3 ABMs.

Such "mixed and matched" CD3 ABMs can be tested using binding assays known in the art (e.g., FACS assays). When chains are mixed and matched, a VH sequence from a particular VH/VL pairing should be replaced with a structurally similar VH sequence. A VL sequence from a particular VH/VL pairing should be replaced with a structurally similar VL sequence.

Accordingly, in one embodiment, a CD3 ABM comprises: a heavy chain variable region (VH) comprising an amino acid sequence selected from any one of the VH sequences described in Table A-J1; and a light chain variable region (VL) comprising an amino acid sequence described in Table A-J2.

In some embodiments, the antigen-binding domain that specifically binds to human CD3 is non-immunoglobulin based and is instead derived from a non-antibody scaffold protein, for example one of the non-antibody scaffold proteins described in Section 7.5.2. In an embodiment, the antigen-binding domain that specifically binds to human CD3 comprises Affilin-144160, which is described in WO 2017/013136. Affilin-144160 has the following amino acid sequence:

(SEQ ID NO: 965)
MQIFVKTLTGKTITLEVEPSDTIENVKAKIQDKEGIPPDQQWLWFAGKQL

EDGRTLSDYNIQKESTLKLWLVDKAAMQIFVYTRTGKTITLEVEPSDTIE

NVKAKIQDKEGIPPDQQRLIWAGKQLEDGRTLSDYNIALESGLHLVLRLR

AA

7.9.2. TCR-α/β ABMs

The MBMs can contain an ABM that specifically binds to the TCR-α chain, the TCR-β chain, or the TCR-αβ dimer. Exemplary anti-TCR-α/β antibodies are known (see, e.g., US 2012/0034221; Borst et al., 1990, Hum Immunol. 29(3): 175-88 (describing antibody BMA031)). The VH, VL, and Kabat CDR sequences of antibody BMA031 are provided in Table 13.

TABLE 13

BMA031 sequences

| Domain | Sequence | SEQ ID NO: |
|---|---|---|
| BMA031 CDR-H1 | KASGYKFTSYVMH | 966 |
| BMA031 CDR-H2 | YINPYNDVTKYNEKFK | 967 |
| BMA031 CDR-H3 | GSYYDYDGFVY | 968 |
| BMA031 CDR-L1 | SATSSVSYMH | 969 |
| BMA031 CDR-L2 | DTSKLAS | 876 |
| BMA031 CDR-L3 | QQWSSNPLT | 904 |
| BMA031 VH | EVQLQQSGPELVKPGASVKMSCKASGYKFTSYVMHWVKQ KPGQGLEWIGYINPYNDVTKYNEKFKGKATLTSDKSSST AYMELSSLTSEDSAVHYCARGSYYDYDGFVYWGQGTLVT VSA | 970 |

TABLE 13-continued

BMA031 sequences

| Domain | Sequence | SEQ ID NO: |
|---|---|---|
| BMA031 VL | QIVLTQSPAIMSASPGEKVTMTCSATSSVSYMHWYQQKS GTSPKRWIYDTSKLASGVPARFSGSGSGTSYSLTISSME AEDAATYYCQQWSSNPLTFGAGTKLELK | 971 |

In an embodiment, a TCR ABM can comprise the CDR sequences of antibody BMA031. In other embodiments, a TCR ABM can comprise the VH and VL sequences of antibody BMA031.

7.9.3. TCR-γ/δ ABMs

The MBMs can contain an ABM that specifically binds to the TCR-γ chain, the TCR-δ chain, or the TCR-γδ dimer. Exemplary anti-TCR-γ/δ antibodies are known (see, e.g., U.S. Pat. No. 5,980,892 (describing δTCS1, produced by the hybridoma deposited with the ATCC as accession number HB 9578)).

7.10. Tumor-Associated Antigen ABMs

The MBMs can comprise an ABM that binds specifically to a tumor-associated antigen (TAA). For example, a BBM can comprise an ABM2 that specifically binds a TAA and a TBM can comprise an ABM3 that specifically binds a TAA or can comprise an ABM2 that specifically binds to a first TAA ("TAA 1") and an AMB3 that specifically binds different TAA ("TAA 2"). In some embodiments, the TAA (or each TAA, in the case of TAA 1 and TAA 2) is a human TAA. A TAA may or may not be present on normal cells. In certain embodiments, a TAA is preferentially expressed or upregulated on tumor cells as compared to normal cells. In other embodiments, a TAA is a lineage marker.

Exemplary TAAs that can be targeted by the MBMs (e.g., targeted by ABM2 and/or ABM3) include ABCF1; ACVR1; ACVR1B; ACVR2; ACVR2B; ACVRL1; ADORA2A; ADRB3; Aggrecan; AGR2; AICDA; AIF1; AIG1; AKAP1; AKAP2; ALK; AMH; AMHR2; ANGPT1; ANGPT2; ANGPTL3; ANGPTL4; ANPEP; APC; APOC1; AR; AZGP1 (zinc-a-glycoprotein); B7.1; B7.2; BAD; BAFF; BAG1; BAI1; BCL2; BCL6; BDNF; BLNK; BLR1 (MDR15); BlyS; BMP1; BMP2; BMP3B (GDF10); BMP4; BMP6; BMP8; BMPR1A; BMPR1B; BMPR2; BPAG1 (plectin); BRCA1; C19orf10 (IL27w); C3; C4A; C5; C5R1; Cadherin 17; CANT1; CASP1; CASP4; CAV1; CCBP2 (D6/JAB61); CCL1 (1-309); CCL11 (eotaxin); CCL13 (MCP-4); CCL15 (MIP-1d); CCL16 (HCC-4); CCL17 (TARC); CCL18 (PARC); CCL19 (MIP-3b); CCL2 (MCP-1); MCAF; CCL20 (MIP-3a); CCL21 (MIP-2); SLC; exodus-2; CCL22 (MDC/STC-1); CCL23 (MPIF-1); CCL24 (MPIF-2/eotaxin-2); CCL25 (TECK); CCL26 (eotaxin-3); CCL27 (CTACK/ILC); CCL28; CCL3 (MIP-1a); CCL4 (MIP-1b); CCL5 (RANTES); CCL7 (MCP-3); CCL8 (mcp-2); CCNA1; CCNA2; CCND1; CCNE1; CCNE2; CCR1 (CKR1/HM145); CCR2 (mcp-1RB/RA); CCR3 (CKR3/CMKBR3); CCR4; CCR5 (CMKBR5/ChemR13); CCR6 (CMKBR6/CKR-L3/STRL22/DRY6); CCR7 (CKR7/EBI1); CCR8 (CMKBR8/TER1/CKR-L1); CCR9 (GPR-9-6); CCRL1 (VSHK1); CCRL2 (L-CCR); CD164; CD19; CD1C; CD20; CD200; CD22; CD24; CD28; CD3; CD37; CD38; CD3E; CD3G; CD3Z; CD4; CD32b; CD40; CD40L; CD44; CD45RB; CD52; CD69; CD72; CD74; CD79A; CD79B; CD8; CD80; CD81; CD83; CD86; CD97; CD123; CD179a; CDH1 (E-cadherin); CDH10; CDH12; CDH13;

CDH18; CDH19; CDH20; CDH5; CDH7; CDH8; CDH9; CDK2; CDK3; CDK4; CDK5; CDK6; CDK7; CDK9; CDKN1A (p21Wap1/Cip1); CDKN1B (p27Kip1); CDKN1C; CDKN2A (p16INK4a); CDKN2B; CDKN2C; CDKN3; CEBPB; CER1; CHGA; CHGB; Chitinase; CHST10; CKLFSF2; CKLFSF3; CKLFSF4; CKLFSF5; CKLFSF6; CKLFSF7; CKLFSF8; CLDN3; CLDN6; CLDN7 (claudin-7); CLN3; CLU (clusterin); CMKLR1; CMKOR1 (RDC1); CNR1; COL18A1; COL1A1; COL4A3; COL6A1; CR2; CRP; CSF1 (M-CSF); CSF2 (GM-CSF); CSF3 (GCSF); CTLA4; CTNNB1 (b-catenin); CTSB (cathepsin B); CX3CL1 (SCYD1); CX3CR1 (V28); CXCL1 (GRO1); CXCL10(IP-10); CXCL11 (1-TAC/IP-9); CXCL12 (SDF1); CXCL13; CXCL14; CXCL16; CXCL2 (GRO2); CXCL3 (GRO3); CXCL5 (ENA-78/LIX); CXCL6 (GCP-2); CXCL9 (MIG); CXCR3 (GPR9/CKR-L2); CXCR4; CXCR6 (TYMSTR/STRL33/Bonzo); CYB5; CYC1; CYSLTR1; CGRP; C1q; C1r; C1; C4a; C4b; C2a; C2b; C3a; C3b; DAB21P; DES; DKFZp451J0118; DNCL1; DPP4; E-selectin; E2F1; ECGF1; EDG1; EFNA1; EFNA3; EFNB2; EGF; EGFR; EGFRvIII; ELAC2; ENG; ENO1; ENO2; ENO3; EPHB4; EPO; ERBB2 (Her-2); EREG; ERK8; ESR1; ESR2; F3 (TF); Factor VII; Factor IX; Factor V; Factor VIIa; Factor Factor X; Factor XII; Factor XIII; FADD; FasL; FASN; FCER1A; FCER2; Fc gamma receptor; FCGR3A; FCRL5; FGF; FGF1 (aFGF); FGF10; FGF11; FGF12; FGF12B; FGF13; FGF14; FGF16; FGF17; FGF18; FGF19; FGF2 (bFGF); FGF20; FGF21; FGF22; FGF23; FGF3 (int-2); FGF4 (HST); FGF5; FGF6 (HST-2); FGF7 (KGF); FGF8; FGF9; FGFR3; FIGF (VEGFD); FIL1 (EPSILON); FIL1 (ZETA); FLJ12584; FLJ25530; FLRT1 (fibronectin); FLT1; Folate receptor alpha; Folate receptor beta; FOS; FOSL1 (FRA-1); Fucosyl GM1; FY (DARC); GABRP (GABAa); GAGEB1; GAGEC1; GALNAC4S-65T; GATA3; GDF5; GFI1; GGT1; GM-CSF; GloboH; GNAS1; GNRH1; GPNMB; GPR2 (CCR10); GPR20; GPR31; GPR44; GPR64; GPR81 (FKSG80); GPRC5D; GRCC10 (C10); GRP; GSN (Gelsolin); GSTP1; glycoprotein (gP)IIb/IIIa; HAVCR1; HAVCR2; HDAC4; HDAC5; HDAC7A; HDAC9; Her2; HER3; HGF; HIF1A; HIP1; histamine and histamine receptors; HLA-A; HLA-DRA; HM74; HMGB1; HMOX1; HMWMAA; HUMCYT2A; ICEBERG; ICOSL; ID2; IFN-α; IFNA1; IFNA2; IFNA4; IFNA5; IFNA6; IFNA7; IFNB1; IFN-γ; IFNW1; IGBP1; IGF1; IGF1R; IGF2; IGFBP2; IGFBP3; IGFBP6; IL-1; IL-α; IL-1-β; IL10; IL10RA; IL10RB; IL11; IL11RA; IL-12; IL12A; IL12B; IL12RB1; IL12RB2; IL13; IL13RA1; IL13RA2; IL14; IL15; IL15RA; IL16; IL17; IL17B; IL17C; IL17R; IL18; IL18BP; IL18R1; IL18RAP; IL19; IL1A; IL1B; IL1F10; IL1F5; IL1F6; IL1F7; IL1F8; IL1F9; IL1HY1; ILR1; IL1R2; IL1RAP; IL1RAPL1; IL1RAPL2; IL1RL1; IL1RL2; IL1RN; IL2; IL20; IL20RA; IL21R; IL22; IL22R; IL22RA2; IL23; IL24; IL25; IL26; IL27; IL28A; IL28B; IL29; IL2RA; IL2RB; IL2RG; IL3; IL30; IL3RA; IL4; IL4R; IL5; IL5RA; IL6; IL6R; IL6ST (glycoprotein 130); IL7; IL7R; IL8; IL8RA; IL8RB; IL8RB; IL9; IL9R; ILK; INHA; INHBA; INSL3; INSL4; IRAK1; IRAK2; ITGA1; ITGA2; ITGA3; ITGA6 (a6 integrin); ITGAV; ITGB3; ITGB4 (b 4 integrin); JAG1; JAK1; JAK3; JUN; K6HF; KAI1; KDR; KITLG; KLF5 (GC Box BP); KLF6; KLK10; KLK12; KLK13; KLK14; KLK15; KLK3; KLK4; KLK5; KLK6; KLK9; KRT1; KRT19 (Keratin 19); KRT2A; KRTHB6 (hair-specific type II keratin); L-selectin; LAMAS; LEP (leptin); Lingo-p75; Lingo-Troy; LRP6; LPS; LTA (TNF-b); LTB; LTB4R (GPR16); LTB4R2; LTBR; LY6K; LYPD8; MACMARCKS; MAG or Omgp; MAP2K7 (c-Jun); MDK; mesothelin; MIB1; midkine; MIF; MIP-2; MKI67 (Ki-67); MMP2; MMP9; MS4A1; MSMB; MT3 (metallothionectin-III); MTSS1; MUC1 (mucin); MYC; MYD88; NCK2; neurocan; NKG2D; NFKB1; NFKB2; NGF; NGFB (NGF); NGFR; NgR-Lingo; NgR-Nogo66 (Nogo); NgR-p75; NgR-Troy; NME1 (NM23A); NOX5; NPPB; NR0B1; NR0B2; NR1D1; NR1D2; NR1H2; NR1H3; NR1H4; NRI12; NRII3; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRP1; NRP2; NT5E; NTN4; NY-BR-1; o-acetyl-GD2; ODZ1; OPRD1; OR51E2; P2RX7; PANX3; PAP; PART1; PATE; PAWR; PCA3; PCNA; PDGFA; PDGFB; PECAM1; PF4 (CXCL4); PGE2; PGF; PGR; phosphacan; PIAS2; PIK3CG; PLAC1; plasminogen activator; PLAU (uPA); PLG; PLXDC1; polysialic acid; PPBP (CXCL7); PPID; PR1; PRKCQ; PRKD1; PRL; PROC; Protein C; PROK2; PSAP; PSCA; PTAFR; PTEN; PTGS2 (COX-2); PTN; RAC2 (p21Rac2); RAGE; RARB; RGS1; RGS13; RGS3; RNF110 (ZNF144); ROBO2; SIO0A2; SCGB1D2 (lipophilin B); SCGB2A1 (mammaglobin 2); SCGB2A2 (mammaglobin 1); SCYE1 (endothelial Monocyte-activating cytokine); SDF2; SERPINA1; SERPINA3; SERPINB5 (maspin); SERPINE1 (PAI-1); SERPINF1; SHBG; SLA2; SLC2A2; SLC33A1; SLC34A2; SLC39A6; SLC43A1; SLIT2; SLITRK6; SPP1; SPRR1B (Spr1); ST6GAL1; STAB1; STATE; STEAP; STEAP2; substance P; TACSTD2; TB4R2; TBX21; TCP10; TDGF1; TEK; TEM1/CD248; TEM7R; TGFA; TGFB1; TGFB1I1; TGFB2; TGFB3; TGFB1; TGFBR1; TGFBR2; TGFBR3; TH1L; THBS1 (thrombospondin-1); THBS2; THBS4; THPO; TIE (Tie-1); TIMP3; tissue factor; TLR10; TLR2; TLR3; TLR4; TLR5; TLR6; TLR7; TLR8; TLR9; TNF; TNF-α; TNFAIP2 (B94); TNFAIP3; TNFRSF11A; TNFRSF1A; TNFRSF1B; TNFRSF21; TNFRSF5; TNFRSF6 (Fas); TNFRSF7; TNFRSF8; TNFRSF9; TNFSF10 (TRAIL); TNFSF11 (TRANCE); TNFSF12 (APO3L); TNFSF13 (April); TNFSF13B; TNFSF14 (HVEM-L); TNFSF15 (VEGI); TNFSF18; TNFSF4 (OX40 ligand); TNFSF5 (CD40 ligand); TNFSF6 (FasL); TNFSF7 (CD27 ligand); TNFSF8 (CD30 ligand); TNFSF9 (4-1BB ligand); TOLLIP; Toll-like receptors; TOP2A (topoisomerase ha); TP53; TPM1; TPM2; TRADD; TRAF1; TRAF2; TRAF3; TRAF4; TRAF5; TRAF6; TREM1; TREM2; TRPC6; TSHR; TSLP; TWEAK; thrombomodulin; thrombin; UPK2; VEGF; VEGFB; VEGFC; versican; VHL C5; VLA-4; XCL1 (lymphotactin); XCL2 (SCM-1b); XCR1 (GPRS/CCXCR1); YY1; and ZFPM2.

In some embodiments, a TAA targeted by a MBM is ADRB3. In some embodiments, a TAA targeted by a MBM is AKAP-4. In some embodiments, a TAA targeted by a MBM is ALK. In some embodiments, a TAA targeted by a MBM is androgen receptor. In some embodiments, a TAA targeted by a MBM is B7H3. In some embodiments, a TAA targeted by a MBM is BCMA. In some embodiments, a TAA targeted by a MBM is BORIS. In some embodiments, a TAA targeted by a MBM is BST2. In some embodiments, a TAA targeted by a MBM is Cadherin17. In some embodiments, a TAA targeted by a MBM is CAIX. In some embodiments, a TAA targeted by a MBM is CD171. In some embodiments, a TAA targeted by a MBM is CD179a. In some embodiments, a TAA targeted by a MBM is CD19. In some embodiments, a TAA targeted by a MBM is CD20. In some embodiments, a TAA targeted by a MBM is CD22. In some embodiments, a TAA targeted by a MBM is CD24. In some embodiments, a TAA targeted by a MBM is CD30. In some embodiments, a TAA targeted by a MBM is CD300LF. In some embodiments, a TAA targeted by a MBM is CD32b. In some embodiments, a TAA targeted by a MBM is CD33. In some embodiments, a TAA targeted by a MBM is CD38. In some embodiments, a TAA targeted by a MBM is CD44v6. In some embodiments, a TAA targeted by a MBM is CD72. In some embodiments, a TAA targeted by a MBM is CD79a. In some embodiments, a TAA targeted by a MBM is CD79b. In some embodiments, a TAA targeted by a MBM is CD97. In some embodiments, a TAA targeted by a MBM is CEA. In some embodiments, a TAA targeted by a MBM is CLDN6. In some embodiments, a TAA targeted by a MBM is CLEC12A. In some embodiments, a TAA targeted by a MBM is CLL-1. In some embodiments, a TAA targeted by a MBM is CS-1. In some embodiments, a TAA targeted by a MBM is CXORF61. In some embodiments, a TAA targeted by a MBM is Cyclin B1. In some embodiments, a TAA targeted by a MBM is CYP1B1. In some embodiments, a TAA targeted by a MBM is EGFR. In some embodiments, a TAA targeted by a MBM is EGFRvIII. In some embodiments, a TAA targeted by a MBM is EMR2. In some embodiments, a TAA targeted by a MBM is EPCAM. In some embodiments, a TAA targeted by a MBM is EphA2. In some embodiments, a TAA targeted by a MBM is EphB2. In some embodiments, a TAA targeted by a MBM is ERBB2. In some embodiments, a TAA targeted by a MBM is ERG (TMPRSS2 ETS fusion gene). In some embodiments, a TAA targeted by a MBM is ETV6-AML. In some embodiments, a TAA targeted by a MBM is FAP. In some embodiments, a TAA targeted by a MBM is FCAR. In some embodiments, a TAA targeted by a MBM is FCRL5. In some embodiments, a TAA targeted by a MBM is FLT3. In some embodiments, a TAA targeted by a MBM is FLT3. In some embodiments, a TAA targeted by a MBM is folate receptor alpha. In some embodiments, a TAA targeted by a MBM is folate receptor beta. In some embodiments, a TAA targeted by a MBM is Fos-related antigen 1. In some embodiments, a TAA targeted by a MBM is fucosyl GM1. In some embodiments, a TAA targeted by a MBM is GD2. In some embodiments, a TAA targeted by a MBM is GD2. In some embodiments, a TAA targeted by a MBM is GD3. In some embodiments, a TAA targeted by a MBM is GloboH. In some embodiments, a TAA targeted by a MBM is GM3. In some embodiments, a TAA targeted by a MBM is gp100Tn. In some embodiments, a TAA targeted by a MBM is GPC3. In some embodiments, a TAA targeted by a MBM is GPNMB. In some embodiments, a TAA targeted by a MBM is GPR20. In some embodiments, a TAA targeted by a MBM is GPRC5D. In some embodiments, a TAA targeted by a MBM is GPR64. In some embodiments, a TAA targeted by a MBM is HAVCR1. In some embodiments, a TAA targeted by a MBM is HER3. In some embodiments, a TAA targeted by a MBM is HMWMAA. In some embodiments, a TAA targeted by a MBM is hTERT. In some embodiments, a TAA targeted by a MBM is Igf-I receptor. In some embodiments, a TAA targeted by a MBM is IGLL1. In some embodiments, a TAA targeted by a MBM is IL-11Ra. In some embodiments, a TAA targeted by a MBM is IL-13Ra2. In some embodiments, a TAA targeted by a MBM is KIT. In some embodiments, a TAA targeted by a MBM is LAIR1. In some embodiments, a TAA targeted by a MBM is LCK. In some embodiments, a TAA targeted by a MBM is LewisY. In some embodiments, a TAA targeted by a MBM is LILRA2. In some embodiments, a TAA targeted by a MBM is LMP2. In some embodiments, a TAA targeted by a MBM is LRP6. In some embodiments, a TAA targeted by a MBM is LY6K. In some embodiments, a TAA targeted by a MBM is LY75. In some embodiments, a TAA targeted by a MBM is LYPD8. In some embodiments, a TAA targeted by a MBM is MAD-CT-1. In some embodiments, a TAA targeted by a MBM is MAD-CT-2. In some embodiments, a TAA targeted by a MBM is mesothelin. In some embodiments, a TAA targeted by a MBM is ML-IAP. In some embodiments, a TAA targeted by a MBM is MUC1. In some embodiments, a TAA targeted by a MBM is MYCN. In some embodiments, a TAA targeted by a MBM is NA17. In some embodiments, a TAA targeted by a MBM is NCAM. In some embodiments, a TAA targeted by a MBM is NKG2D. In some embodiments, a TAA targeted by a MBM is NY-BR-1. In some embodiments, a TAA targeted by a MBM is o-acetyl-GD2. In some embodiments, a TAA targeted by a MBM is OR51E2. In some embodiments, a TAA targeted by a MBM is OY-TES1. In some embodiments, a TAA targeted by a MBM is a p53 mutant. In some embodiments, a TAA targeted by a MBM is PANX3. In some embodiments, a TAA targeted by a MBM is PAX3. In some embodiments, a TAA targeted by a MBM is PAX5. In some embodiments, a TAA targeted by a MBM is PDGFR-beta. In some embodiments, a TAA targeted by a MBM is PLAC1. In some embodiments, a TAA targeted by a MBM is polysialic acid. In some embodiments, a TAA targeted by a MBM is PRSS21. In some embodiments, a TAA targeted by a MBM is PSCA. In some embodiments, a TAA targeted by a MBM is RhoC. In some embodiments, a TAA targeted by a MBM is ROR1. In some embodiments, a TAA targeted by a MBM is a sarcoma translocation breakpoint protein. In some embodiments, a TAA targeted by a MBM is SART3. In some embodiments, a TAA targeted by a MBM is SLC34A2. In some embodiments, a TAA targeted by a MBM is SLC39A6. In some embodiments, a TAA targeted by a MBM is sLe. In some embodiments, a TAA targeted by a MBM is SLITRK6. In some embodiments, a TAA targeted by a MBM is sperm protein 17. In some embodiments, a TAA targeted by a MBM is SSEA-4. In some embodiments, a TAA targeted by a MBM is SSX2. In some embodiments, a TAA targeted by a MBM is TAAG72. In some embodiments, a TAA targeted by a MBM is TAARP. In some embodiments, a TAA targeted by a MBM is TACSTD2. In some embodiments, a TAA targeted by a MBM is TEM1/CD248. In some embodiments, a TAA targeted by a MBM is TEM7R. In some embodiments, a TAA targeted by a MBM is TGS5. In some embodiments, a TAA targeted by a MBM is Tie 2. In some embodiments, a TAA targeted by a MBM is Tn Ag. In some embodiments, a TAA targeted by a MBM is TSHR. In some embodiments, a TAA targeted by a MBM is tyrosinase. In some embodiments, a TAA targeted by a MBM is UPK2. In some embodiments, a TAA targeted by a MBM is VEGFR2. In some embodiments, a TAA targeted by a MBM is WT1. In some embodiments, a TAA targeted by a MBM is XAGE1.

In some embodiments, a TAA targeted by a MBM is selected from BCMA, CD19, CD20, CD22, CD123, CD33, CLL1, CD138 (also known as Syndecan-1, SDC1), CS1, CD38, CD133, FLT3, CD52, TNFRSF13C (TNF Receptor Superfamily Member 13C, also known as BAFFR: B-Cell-Activating Factor Receptor), TNFRSF13B (TNF Receptor Superfamily Member 13B, also known as TACI: Transmembrane Activator And CAML Interactor), CXCR4 (C-X-C Motif Chemokine Receptor 4), PD-L1 (programmed death-ligand 1), LY9 (lymphocyte antigen 9, also known as CD229), CD200, FCGR2B (Fc fragment of IgG receptor IIb, also known as CD32b), CD21, CD23, CD24, CD40L, CD72, CD79a, and CD79b.

In some embodiments a TAA targeted by a MBM is CD19. In some embodiments, a TAA targeted by a MBM is BCMA. In some embodiments, a TAA targeted by a MBM is CD20. In some embodiments, a TAA targeted by a MBM is CD22. In some embodiments, a TAA targeted by a MBM is CD123. In some embodiments, a TAA targeted by a MBM is CD33. In some embodiments, a TAA targeted by a MBM is CLL1. In some embodiments, a TAA targeted by a MBM is CD138. In some embodiments, a TAA targeted by a MBM is CS1. In some embodiments, a TAA targeted by a MBM is CD38. In some embodiments, a TAA targeted by a MBM is CD133. In some embodiments, a TAA targeted by a MBM is FLT3. In some embodiments, a TAA targeted by a MBM is CD52. In some embodiments, a TAA targeted by a MBM is TNFRSF13C. In some embodiments, a TAA targeted by a MBM is TNFRSF13B. In some embodiments, a TAA targeted by a MBM is CXCR4. In some embodiments, a TAA targeted by a MBM is PD-L1. In some embodiments, a TAA targeted by a MBM is LY9. In some embodiments, a TAA targeted by a MBM is CD200. In some embodiments, a TAA targeted by a MBM is CD21. In some embodiments, a TAA targeted by a MBM is CD23. In some embodiments, a TAA targeted by a MBM is CD24. In some embodiments, a TAA targeted by a MBM is CD40L. In some embodiments, a TAA targeted by a MBM is CD72. In some embodiments, a TAA targeted by a MBM is CD79a. In some embodiments, a TAA targeted by a MBM is CD79b.

In some embodiments, a MBM targets two TAAs (TAA 1 and TAA 2) selected from the TAAs described in this Section.

A TAA-binding ABM can comprise, for example, an anti-TAA antibody or an antigen-binding fragment thereof. The anti-TAA antibody or antigen-binding fragment can comprise, for example, the CDR sequences of an antibody set forth in Table 14A or Table 14B. In some embodiments, the anti-TAA antibody or antigen-binding domain thereof has the heavy and light chain variable region sequences of an antibody set forth in Table 14A. In some embodiments, the anti-TAA antibody or antigen-binding domain thereof has the heavy and light chain variable region sequences of an antibody set forth in Table 14B.

TABLE 14A

Exemplary Anti-Tumor-Associated Antigen Antibodies

| Target | Examples of Antibody Name and/or Reference(s) and/or Source |
|---|---|
| ALK | antibodies described in e.g., Mino-Kenudson et al., 2010, Clin Cancer Res 16(5): 1561-1571 |
| B7H3 | MGA271 (Macrogenics) |
| BCMA | Any BCMA antibody described in WO2012163805, WO200112812, or WO2003062401. |
| CAIX | Antibody clone 303123 (R&D Systems) |
| CD123 | U.S. Pat. No. 8,852,551; EP2426148; WO2014138819; WO2016028896; WO2014130635 |
| CD171 | Hong et al., 2014, J Immunother 37(2): 93-104. |
| CD19 | WO2014031687; WO2012079000; WO2014153270; U.S. Pat. No. 7,741,465; the CD19 binder of Yescarta or Blinatumomab |
| CD20 | Rituximab, Ofatumumab, Ocrelizumab, Veltuzumab, or GA101 |
| CD22 | Haso et al., 2013, Blood, 121(7): 1165-1174; Wayne et al., 2010, Clin Cancer Res 16(6): 1894-1903; Kato et al., 2013, Leuk Res 37(1): 83-88; Creative BioMart (creativebiomart.net): MOM-18047-S(P). |
| CD24 | Maliar et al., Gastroenterology 143(5): 1375-1384 (2012) |
| CD30 | Any CD30 antibody described in U.S. Pat. No. 7,090,843 B1, or EP0805871 |
| CD33 | Bross et al., 2001, Clin Cancer Res 7(6): 1490-1496 (Gemtuzumab Ozogamicin, hP67.6), Caron et al., 1992, Cancer Res 52(24): 6761-6767 (Lintuzumab, HuM195), Lapusan et al., 2012, Invest New Drugs 30(3): 1121-1131 (AVE9633), Aigner et al., 2013, Leukemia 27(5): 1107-1115 (AMG330, CD33 BiTE), Dutour et al., 2012, Adv Hematol 2012: 683065, or Pizzitola et al., 2014, Leukemia doi: 10.1038/Lue.2014.62. |
| CD38 | Daratumumab (see, e.g., Groen et al., 2010, Blood 116(21): 1261-1262; MOR202 (see, e.g., U.S. Pat. No. 8,263,746); or any CD38 antibody described in U.S. Pat. No. 8,362,211. |
| CD44v6 | Casucci et al., 2013, Blood 122(20): 3461-3472. |
| CD97 | antibodies described in, e.g., U.S. Pat. No. 6,846,911; de Groot et al., 2009, J Immunol 183(6): 4127-4134; antibody from R&D: MAB373 |
| CEA | Chmielewski et al., 2012, Gastoenterology 143(4): 1095-1107. |
| CLDN6 | WO2015069794; IMAB027, mAb, Ganymed Pharmaceuticals |
| CLL-1 | PE-CLL1-hu Cat# 353604 (BioLegend); and PE-CLL1 (CLEC12A) Cat# 562566 (BD); WO 2014/051433 A1; US 2016/0368994 A1; US 2013/0295118 A1; U.S. Pat. No. 8,536,310 B2; Lu et al., 2014, Angewandte Chemie International Edition 53(37): 9841-9845; Leong et al., 2017, Blood 129(5): 609-618 |
| CS1 | Elotuzumab (BMS), see e.g., Tai et al., 2008, Blood 112(4): 1329-37; Tai et al., 2007, Blood. 110(5): 1656-63. |
| EGFR | Cetuximab, panitumumab, zalutumumab, nimotuzumab, or matuzumab |
| EGFRvIII | WO2012138475; WO2014130657 |
| EPCAM | MT110, EpCAM-CD3 bispecific Ab (see, e.g., clinicaltrials.gov/ct2/show/NCT00635596); Edrecolomab; 3622W94; ING-1; or adecatumumab (MT201). |
| EphA2 | Yu et al., 2014, Mol Ther22(1): 102-111. |
| Ephrin B2 | Abengozar et al., 2012, Blood 119(19): 4565-4576. |
| ERBB2 (Her2/neu) | Trastuzumab or pertuzumab. |
| FAP | Ostermann et al., 2008, Clinical Cancer Research 14: 4584-4592 (FAP5), U.S. Pat. Publication No. 2009/0304718; sibrotuzumab (see e.g., Hofheinz et al., 2003, Oncology Research and Treatment 26(1): 44-48); and Tran et al., 2013, J Exp Med 210(6): 1125-1135. |
| FLT3 | Any FLT3 antibody described in WO2011076922, U.S. Pat. No. 5,777,084, EP0754230, or US20090297529. |

TABLE 14A-continued

Exemplary Anti-Tumor-Associated Antigen Antibodies

| Target | Examples of Antibody Name and/or Reference(s) and/or Source |
|---|---|
| Folate receptor alpha | IMGN853, or any folate receptor alpha antibody described in US20120009181; U.S. Pat. No. 4,851,332, LK26: U.S. Pat No. 5,952,484. |
| Folate receptor beta | antibodies described in, e.g., US20100297138; WO2007/067992 |
| GD2 | Mujoo et al., Cancer Res. 47(4): 1098-1104 (1987); Cheung et al., Cancer Res 45(6): 2642-2649 (1985), Cheung et al., J Clin Oncol 5(9): 1430-1440 (1987), Cheung et al., J Clin Oncol 16(9): 3053-3060 (1998), Handgretinger et al., Cancer Immunol Immunother 35(3): 199-204 (1992); mAb 14.18, 14G2a, ch14.18, hu14.18, 3F8, hu3F8, 3G6, 8B6, 60C3, 10B8, ME36.1, or 8H9 (see e.g., WO2012033885, WO2013040371, WO2013192294, WO2013061273, WO2013123061, WO2013074916, and WO2013385552). Any GD2 antibody described in US Publication No.: 20100150910 or PCT Publication No.: WO 2011160119. |
| GD3 | Any GD3 antibody described in U.S. Pat. No. 7,253,263; U.S. Pat. No. 8,207,308; US 20120276046; EP1013761; WO2005035577; or U.S. Pat. No. 6,437,098. |
| GloboH | VK9; Kudryashov et al., 1998, Glycoconj J.15(3): 243-9; Lou et al., 2014, Proc Natl Acad Sci USA 111(7): 2482-2487; MBr1: Bremer et al., 1984, J Biol Chem 259: 14773-14777. |
| gp100 | HMB45, NKIbetaB, or any anti-gp100 antibody described in WO2013165940, or US20130295007 |
| GPRC5D | R&Dsystems: FAB6300A; Lifespan Biosciences: LS-A4180 |
| HMWMAA | antibodies described in, e.g., Kmiecik et al., 2014, Oncoimmunology 3(1): e27185 (PMID: 24575382) (mAb9.2.27); U.S. Pat. No. 6,528,481; WO2010033866; US 20140004124 |
| IGF-I receptor | Any IGF-I receptor antibody described in US8344112 B2; EP2322550 A1; WO 2006/138315, or PCT/US2006/022995. |
| IL-11Ra | Abcam (cat# ab55262) or Novus Biologicals (cat# EPR5446) |
| IL-13Ra2 | Any IL-13Ra2 antibody described in WO2008/146911, WO2004087758, or WO2004087758 |
| KIT | Any KIT antibody described in U.S. Pat. No. 7,915,391, US20120288506 |
| KLRG2 | ab121563 (Abcam); B-12 or sc-514346 (Santa Cruz); HPA018199 (Sigma Aldrich) |
| LewisY | Kelly et al., Cancer Biother Radiopharm 23(4): 411-423 (2008) (hu3S193 Ab (scFvs)); Dolezal et al., Protein Engineering 16(1): 47-56 (2003) (NC10 scFv) |
| LMP2 | Any LMP2 antibody described in U.S. Pat. No. 7,410,640 or US 2005/0129701 |
| LRP6 | WO2009064944, WO2009056634, WO2011119661, WO2011138392, WO2011138391, WO2013067355, WO2014029752, WO2017093478 |
| Mesothelin | Any mesothelin antibody described in US 20110262448, US 2012/0107933 or U.S. Pat. No. 9,719,996 |
| MUC1 | SAR566658 |
| NCAM | 2-2B: MAB5324 (EMD Millipore) |
| NY-BR-1 | antibodies described in, e.g., Jager et al., 2007, Appl Immunohitochem Mol Morphol 15(1): 77-83 |
| o-acetyl-GD2 | 8B6 |
| PDGFR-beta | Abcam ab32570 |
| PLAC1 | antibodies described in, e.g., Ghods et al., 2013, Biotechnol Appl Biochem doi: 10.1002/bab.1177 |
| Polysialic acid | antibodies described in e.g., Nagae et al., 2013, J Biol Chem 288(47): 33784-33796 |
| PRSS21 | Any PRSS21 antibody described in U.S. Pat. No.: 8,080,650. |
| PSCA | Morgenroth et al., Prostate 67(10): 1121-1131 (2007) (scFv 7F5); Nejatollahi et al., J of Oncology 2013(2013), article ID 839831 (scFv C5-II); or any PSCA antibody described in US Pat Publication No. 20090311181. |
| PSMA | Parker et al., Protein Expr Purif 89(2): 136-145 (2013), US 20110268656 (J591 ScFv); Frigerio et al, European J Cancer49(9): 2223-2232 (2013) (scFvD2B); WO 2006125481 (mAbs 3/A12, 3/E7 and 3/F11) or single chain antibody fragments (scFv A5 and D7). |
| ROR1 | Hudecek et al., Clin Cancer Res 19(12): 3153-3164 (2013); or any ROR1 antibody described in WO 2011159847 or US20130101607. |
| SSEA-4 | MC813 (Cell Signaling) |
| TAG72 | Hornbach et al., Gastroenterology 113(4): 1163-1170 (1997) or Abcam ab691. |
| TEM1/CD248 | antibodies described in, e.g., Marty et al., 2006, Cancer Lett235(2): 298-308; Zhao et al., 2011, J Immunol Methods 363(2): 221-232 |
| Tn | Brooks et al., PNAS 107(22): 10056-10061 (2010); Stone et al., OncoImmunology 1(6): 863-873(2012); any Tn antibody described in U.S. Pat. No. 8,440,798 |
| TSHR | antibodies described in, e.g., Marty et al., 2006, Cancer Lett 235(2): 298-308; Zhao et al., 2011, J Immunol Methods 363(2): 221-232 |
| Tyrosinase | Any tyrosinase antibody described in U.S. Pat. No. 5,843,674 or U.S. Pat. No. 19,950,504,048. |
| VEGFR2 | Chinnasamy et al., J Clin Invest 120(11): 3953-3968 (2010). |

TABLE 14B

| | Exemplary Anti-Tumor-Associated Antigen Antibodies |
|---|---|
| Target | Examples of Antibody Name and/or Reference(s) and/or Source |
| CD123 | Any CD123 antibody described in U.S. Pat. No. 8,852,551, EP2426148, WO 2014/138819, WO 2016/028896, or WO 2014/130635 |
| BCMA | Any BCMA antibody described in WO2012163805, WO200112812, or WO2003062401. |
| CD20 | Rituximab, Ofatumumab, Ocrelizumab, Veltuzumab, or GA101 |
| CD22 | Any CD22 antibody described in Haso et al., 2013, Blood, 121(7): 1165-1174, Wayne et al., 2010, Clin Cancer Res 16(6): 1894-1903, Kato et al., 2013, Leuk Res 37(1): 83-88, or Creative BioMart (creativebiomart.net): MOM-18047-S(P). |
| CD33 | Any CD33 antibody described in Bross et al., 2001, Clin Cancer Res 7(6): 1490-1496 (Gemtuzumab Ozogamicin, hP67.6), Caron et al., 1992, Cancer Res 52(24): 6761-6767 (Lintuzumab, HuM195), Lapusan et al., 2012, Invest New Drugs 30(3): 1121-1131 (AVE9633), Aigner et al., 2013, Leukemia 27(5): 1107-1115 (AMG330, CD33 BiTE), Dutour et al., 2012, Adv Hematol 2012: 683065, or Pizzitola et al., 2014, Leukemia doi: 10.1038/Lue.2014.62. |
| CD38 | Daratumumab (see, e.g., Groen et al., 2010, Blood 116(21): 1261-1262; MOR202 (see, e.g., U.S. Pat. No. 8,263,746); or any CD38 antibody described in U.S. Pat. No. 8,362,211. |
| CLL-1 | PE-CLL1-hu Cat# 353604 (BioLegend); PE-CLL1 (CLEC12A) Cat# 562566 (BD); Any CLL-1 antibody described in WO 2014/051433 A1, US 2016/0368994 A1, US 2013/0295118 A1, U.S. Pat. No. 8,536,310 B2, Lu et al., 2014, Angewandte Chemie International Edition 53(37): 9841-9845, or Leong et al., 2017, Blood 129(5): 609-618 |
| CS1 | Elotuzumab (BMS), see e.g., Tai et al., 2008, Blood 112(4): 1329-37; Tai et al., 2007, Blood. 110(5): 1656-63. |
| FLT3 | Any FLT3 antibody described in WO 2011/076922, U.S. Pat. No. 5,777,084, EP0754230, or US 2009/0297529. |
| CD133 | Any CD133 antibody described in U.S. Pat. No. 9,624,303, WO 2016/154623, or WO 2011/089211; 5E3 (ThermoFisher); MAB11331 (R&D Systems); MAB4310 (Millipore Sigma) |
| CD138 | Any CD138 antibody described in WO/2009/080829, WO/2017/014679, or U.S. Pat. No. 9,289,509; nBT062 (Biotest AG); MI15, B-A38, SP152, DL-101 (ThermoFisher) |
| CD52 | alemtuzumab (Genzyme); ANT1034 (see, Holgate et al., 2015, PLOS ONE 10(9): e0138123; any CD52 antibody described in WO/2010/132659; any CD52 antibody described in U.S. Pat. No. 9,708,407; any CD52 antibody described in WO/2010/132659 |
| TNFRSF13C | Any TNFRSF13C antibody described in WO 2010/007082, U.S. Pat. No. 9,382,326 |
| TNFRSF13B | Any TNFRSF13B antibody described in WO 2004/011611; LS-C89973 (Lifespan Biosciences, Inc.) M02952-1 (Boster Biological Technology); MAB1041, MAB1741, and MAB174 (R&D Systems) |
| CXCR4 | Any CXCR4 antibody described in U.S. Pat. Nos. 7,138,496, 8,329,178, 8,450,464, 9,249,223, or 9,260,527 |
| PD-L1 | Any PD-L1 antibody described in US 2015/0203580, US 2017/0058033, US 2017/0204184, U.S. Pat. No. 8,741,295, U.S. Pat. No. 9,789,183, or U.S. Pat. No. 9,637,546 |
| LY9 | HLy9.25 (e.g., Lifespan Biosciences, Inc. cat. no. LS-C112605); MAB1898 (R&D Systems) |
| CD200 | Any CD200 antibody described in U.S. Pat. No. 7,887,798; ab23552 (Abcam); Ox104 (ThermoFisher) |
| FCGR2B | Any FCGR2B antibody described in U.S. Pat. No. 8,802,089 or WO 2017/103895; ab45143 (Abcam); AT130-2 (ThermoFisher); 2E10 (Millipore Sigma) |
| CD21 | ab75985 (Abcam); ab9492 (Abcam); 2G9 (ThermoFisher); HB5 (ThermoFisher); MAB4909 (R&D Systems) |
| CD23 | Any CD23 antibody described in U.S. Pat. No. 7,008,623 or U.S. Pat. No. 6,011,138; lumiliximab (Biogen); ab16702 (Abcam); SP23 (ThermoFisher) |
| CD24 | Any CD24 antibody described in U.S. Pat. No. 8,614,301; SN3 (ThermoFisher); SN3b (ThermoFisher); 2Q1282 (Santa Cruz Biotechnology); 3H1143 (Santa Cruz Biotechnology); ALB9 (Santa Cruz Biotechnology); MAB5248 (R&D Systems) |
| CD40L | Any CD40L antibody described in U.S. Pat. No. 9,228,018 or US 2003/0099642; 24-31 (Biolegend); ab52750 (Abcam); ab47204 (Abcam); CDP7657 (UCB Pharma); 5c8 (Biogen) |
| CD72 | 3F3 (Biolegend); Bu40 (ThermoFisher); H-7 (Santa Cruz Biotechnology); H-96 (Santa Cruz Biotechnology); G-5 (Santa Cruz Biotechnology); ab92509 (Abcam) |
| CD79a | ab62650 (Abcam); ab79414 (Abcam); MAB69201 (R&D Systems); HM57 (Bio-Rad) |
| CD79b | Any CD79b antibody described in WO 2014/011521; ab130422 (Abcam); ab134147 (Abcam); polatuzumab (Genentech) |

In certain embodiments, a TAA targeted by a MBM is expressed or upregulated on cancerous B cells as compared to normal B cells. In other embodiments, a TAA targeted by a MBM is a B cell lineage marker.

It is anticipated that any type of B cell malignancy can be targeted by the MBMs of the disclosure in which ABM3 binds to TAA that is expressed on cancerous B cells, for example BCMA, CD19 or CD20. Exemplary types of B cell malignancies that can be targeted include Hodgkin's lymphomas, non-Hodgkin's lymphomas (NHLs), and multiple myeloma. Examples of NHLs include diffuse large B-cell lymphoma (DLBCL), follicular lymphoma, chronic lymphocytic leukemia (CLL)/small lymphocytic lymphoma (SLL), mantle cell lymphoma (MCL), marginal zone lymphomas, Burkitt lymphoma, lymphoplasmacytic lymphoma (Waldenstrom macroglobulinemia), hairy cell leukemia, primary central nervous system (CNS) lymphoma, primary mediastinal large B-cell lymphoma, mediastinal grey-zone lymphoma (MGZL), splenic marginal zone B-cell lymphoma, extranodal marginal zone B-cell lymphoma of MALT, nodal marginal zone B-cell lymphoma, and primary effusion lymphoma.

7.10.1. BCMA

In certain aspects, the present disclosure provides a MBM in which ABM2 or ABM3 is BCMA. BCMA is a tumor necrosis family receptor (TNFR) member expressed on cells of the B-cell lineage. BCMA expression is the highest on terminally differentiated B cells that assume the long lived plasma cell fate, including plasma cells, plasmablasts and a subpopulation of activated B cells and memory B cells. BCMA is involved in mediating the survival of plasma cells for maintaining long-term humoral immunity. The expression of BCMA has been recently linked to a number of cancers, autoimmune disorders, and infectious diseases. Cancers with increased expression of BCMA include some hematological cancers, such as multiple myeloma, Hodgkin's and non-Hodgkin's lymphoma, various leukemias, and glioblastoma.

MBMs comprising an ABM that binds to BCMA can comprise, for example, an anti-BCMA antibody or an antigen-binding domain thereof. The anti-BCMA antibody or antigen-binding domain thereof can comprise, for example, CDR, VH, VL, or scFV sequences set forth in Tables 15A-15G.

TABLE 15A

BCMA Binders - Variable domain and scFv sequences

| Antibody | Domain | Sequence | SEQ ID NO. |
|---|---|---|---|
| BCMA-1 | VH | EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS | 263 |
|  | VL | DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK | 264 |
|  | scFv | EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK | 265 |
| BCMA-2 | VH | QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS | 266 |
|  | VL | DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK | 267 |
|  | scFv | QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK | 268 |
| BCMA-3 | VH | QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS | 269 |
|  | VL | DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK | 270 |
|  | scFv | QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK | 271 |
| BCMA-4 | VH | EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS | 272 |
|  | VL | DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK | 273 |

TABLE 15A-continued

BCMA Binders - Variable domain and scFv sequences

| Antibody | Domain | Sequence | SEQ ID NO. |
|---|---|---|---|
| | scFv | EVQLLESGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SDIVMTQTPLSLSVTPGQPASISCKSSQSLLRNDGKTPLYWYLQKA GQPPQLLIYEVSNRFSGVPDRFSGSGSGTDFTLKISRVEAEDVGA YYCMQNIQFPSFGGGTKLEIK | 274 |
| BCMA-5 | VH | QVQLVQSGAEVRKTGASVKVSCKASGYIFDNFGINWVRQAPGQG LEWMGWINPKNNNTNYAQKFQGRVTITADESTNTAYMEVSSLRS EDTAVYYCARGPYYYQSYMDVWGQGTMVTVSS | 275 |
| | VL | DIVMTQTPLSLPVTPGEPASISCRSSQSLLHSNGYNYLNWYLQKP GQSPQLLIYLGSKRASGVPDRFSGSGSGTDFTLHITRVGAEDVGV YYCMQALQTPYTFGQGTKLEIK | 276 |
| | scFv | QVQLVQSGAEVRKTGASVKVSCKASGYIFDNFGINWVRQAPGQG LEWMGWINPKNNNTNYAQKFQGRVTITADESTNTAYMEVSSLRS EDTAVYYCARGPYYYQSYMDVWGQGTMVTVSSASGGGGSGGR ASGGGGSDIVMTQTPLSLPVTPGEPASISCRSSQSLLHSNGYNYL NWYLQKPGQSPQLLIYLGSKRASGVPDRFSGSGSGTDFTLHITRV GAEDVGVYYCMQALQTPYTFGQGTKLEIK | 277 |
| BCMA-6 | VH | QVQLQESGGGLVQPGGSLRLSCAASGFTFSSDAMTWVRQAPGK GLEWVSVISGSGGTTYYADSVKGRFTISRDNSKNTLYLQMNSLRA EDTAVYYCAKLDSSGYYYARGPRYWGQGTLVTVSS | 278 |
| | VL | DIQLTQSPSSLSASVGDRVTITCRASQSISSYLNWYQQKPGKAPKL LIYGASTLASGVPARFSGSGSGTHFTLTINSLQSEDSATYYCQQSY KRASFGQGTKVEIK | 279 |
| | scFv | QVQLQESGGGLVQPGGSLRLSCAASGFTFSSDAMTWVRQAPGK GLEWVSVISGSGGTTYYADSVKGRFTISRDNSKNTLYLQMNSLRA EDTAVYYCAKLDSSGYYYARGPRYWGQGTLVTVSSASGGGGSG GRASGGGGSDIQLTQSPSSLSASVGDRVTITCRASQSISSYLNWY QQKPGKAPKLLIYGASTLASGVPARFSGSGSGTHFTLTINSLQSED SATYYCQQSYKRASFGQGTKVEIK | 280 |
| BCMA-7 | VH | QVQLVQSGAEVKKPGASVKVSCKASGYTFSNYGITWVRQAPGQG LEWMGWISAYNGNTNYAQKFQGRVTMTRNTSISTAYMELSSLRS EDTAVYYCARGPYYYYMDVWGKGTMVTVSS | 281 |
| | VL | EIVMTQSPLSLPVTPGEPASISCRSSQSLLYSNGYNYVDWYLQKP GQSPQLLIYLGSNRASGVPDRFSGSGSGTDFKLQISRVEAEDVGIY YCMQGRQFPYSFGQGTKVEIK | 282 |
| | scFv | QVQLVQSGAEVKKPGASVKVSCKASGYTFSNYGITWVRQAPGQG LEWMGWISAYNGNTNYAQKFQGRVTMTRNTSISTAYMELSSLRS EDTAVYYCARGPYYYYMDVWGKGTMVTVSSASGGGGSGGRAS GGGGSEIVMTQSPLSLPVTPGEPASISCRSSQSLLYSNGYNYVDW YLQKPGQSPQLLIYLGSNRASGVPDRFSGSGSGTDFKLQISRVEA EDVGIYYCMQGRQFPYSFGQGTKVEIK | 283 |
| BCMA-8 | VH | EVQLLETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 284 |
| | VL | EIVLTQSPATLSVSPGESATLSCRASQSVSSNLAWYQQKPGQAPR LLIYGASTRASGIPDRFSGSGSGTDFTLTISSLQAEDVAVYYCQQY GSSLTFGGGTKVEIK | 285 |
| | scFv | EVQLLETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SEIVLTQSPATLSVSPGESATLSCRASQSVSSNLAWYQQKPGQAP RLLIYGASTRASGIPDRFSGSGSGTDFTLTISSLQAEDVAVYYCQQ YGSSLTFGGGTKVEIK | 286 |
| BCMA-9 | VH | EVQLVETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 287 |
| | VL | EIVMTQSPATLSVSPGERATLSCRASQSVSSKLAWYQQKPGQAP RLLMYGASIRATGIPDRFSGSGSGTEFTLTISSLEPEDFAVYYCQQ YGSSSWTFGQGTKVEIK | 288 |
| | scFv | EVQLVETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SEIVMTQSPATLSVSPGERATLSCRASQSVSSKLAWYQQKPGQA PRLLMYGASIRATGIPDRFSGSGSGTEFTLTISSLEPEDFAVYYCQ QYGSSSWTFGQGTKVEIK | 289 |

TABLE 15A-continued

BCMA Binders - Variable domain and scFv sequences

| Antibody | Domain | Sequence | SEQ ID NO. |
|---|---|---|---|
| BCMA-10 | VH | EVQLVETGGGVVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 290 |
| | VL | EIVLTQSPGTLSLSPGERATLSCRASQSVGSTNLAWYQQKPGQAP RLLIYDASNRATGIPDRFSGGGSGTDFTLTISRLEPEDFAVYYCQQ YGSSPPWTFGQGTKVEIK | 291 |
| | scFv | EVQLVETGGGVVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SEIVLTQSPGTLSLSPGERATLSCRASQSVGSTNLAWYQQKPGQA PRLLIYDASNRATGIPDRFSGGGSGTDFTLTISRLEPEDFAVYYCQ QYGSSPPWTFGQGTKVEIK | 292 |
| BCMA-11 | VH | QVQLVESGGGLVKPGGSLRLSCAASGFTFSDYYMSWIRQAPGKG LEWVSYISSSGSTIYYADSVKGRFTISRDNAKNSLYLQMNSLRAED TAVYYCARESGDGMDVWGQGTTVTVSS | 293 |
| | VL | DIQMTQSPSSLSASVGDRVTITCRASQSISSYLNWYQQKPGKAPK LLIYAASSLQSGVPSRFSGSGSGTDFTLTISSLQPEDFATYYCQQS YTLAFGQGTKVDIK | 294 |
| | scFv | QVQLVESGGGLVKPGGSLRLSCAASGFTFSDYYMSWIRQAPGKG LEWVSYISSSGSTIYYADSVKGRFTISRDNAKNSLYLQMNSLRAED TAVYYCARESGDGMDVWGQGTTVTVSSASGGGGSGGRASGGG GSDIQMTQSPSSLSASVGDRVTITCRASQSISSYLNWYQQKPGKA PKLLIYAASSLQSGVPSRFSGSGSGTDFTLTISSLQPEDFATYYCQ QSYTLAFGQGTKVDIK | 295 |
| BCMA-12 | VH | QVQLVQSGGGLVKPGGSLRLSCAASGFTFSDYYMSWIRQAPGKG LEWVSYISSSGNTIYYADSVKGRFTISRDNAKNSLYLQMNSLRAED TAVYYCARSTMVREDYWGQGTLVTVSS | 296 |
| | VL | DIVLTQSPLSLPVTLGQPASISCKSSESLVHNSGKTYLNWFHQRPG QSPRRLIYEVSNRDSGVPDRFTGSGSGTDFTLKISRVEAEDVGVY YCMQGTHWPGTFGQGTKLEIK | 297 |
| | scFv | QVQLVQSGGGLVKPGGSLRLSCAASGFTFSDYYMSWIRQAPGKG LEWVSYISSSGNTIYYADSVKGRFTISRDNAKNSLYLQMNSLRAED TAVYYCARSTMVREDYWGQGTLVTVSSASGGGGSGGRASGGG GSDIVLTQSPLSLPVTLGQPASISCKSSESLVHNSGKTYLNWFHQR PGQSPRRLIYEVSNRDSGVPDRFTGSGSGTDFTLKISRVEAEDVG VYYCMQGTHWPGTFGQGTKLEIK | 298 |
| BCMA-13 | VH | QVQLVESGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 299 |
| | VL | DIRLTQSPSPLSASVGDRVTITCQASEDINKFLNWYHQTPGKAPKL LIYDASTLQTGVPSRFSGSGSGTDFTLTINSLQPEDIGTYYCQQYE SLPLTFGGGTKVEIK | 300 |
| | scFv | QVQLVESGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SDIRLTQSPSPLSASVGDRVTITCQASEDINKFLNWYHQTPGKAPK LLIYDASTLQTGVPSRFSGSGSGTDFTLTINSLQPEDIGTYYCQQY ESLPLTFGGGTKVEIK | 301 |
| BCMA-14 | VH | EVQLVETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 287 |
| | VL | ETTLTQSPATLSVSPGERATLSCRASQSVGSNLAWYQQKPGQGP RLLIYGASTRATGIPARFSGSGSGTEFTLTISSLQPEDFAVYYCQQY NDWLPVTFGQGTKVEIK | 302 |
| | scFv | EVQLVETGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSSASGGGGSGGRASGGGG SETTLTQSPATLSVSPGERATLSCRASQSVGSNLAWYQQKPGQG PRLLIYGASTRATGIPARFSGSGSGTEFTLTISSLQPEDFAVYYCQQ YNDWLPVTFGQGTKVEIK | 303 |
| BCMA-15 | VH | EVQLVESGGGLVQPGGSLRLSCAVSGFALSNHGMSWVRRAPGK GLEWVSGIVYSGSTYYAASVKGRFTISRDNSRNTLYLQMNSLRPE DTAIYYCSAHGGESDVWGQGTTVTVSS | 263 |
| | VL | EIVLTQSPGTLSLSPGERATLSCRASQSIGSSSLAWYQQKPGQAP RLLMYGASSRASGIPDRFSGSGSGTDFTLTISRLEPEDFAVYYCQ QYAGSPPFTFGQGTKVEIK | 304 |
| | scFv | EVQLVESGGGLVQPGGSLRLSCAVSGFALSNHGMSWVRRAPGK GLEWVSGIVYSGSTYYAASVKGRFTISRDNSRNTLYLQMNSLRPE | 305 |

TABLE 15A-continued

BCMA Binders - Variable domain and scFv sequences

| Antibody | Domain | Sequence | SEQ ID NO. |
|---|---|---|---|
| | | DTAIYYCSAHGGESDVWGQGTTVTVSSASGGGGSGGRASGGGG SEIVLTQSPGTLSLSPGERATLSCRASQSIGSSSLAWYQQKPGQA PRLLMYGASSRASGIPDRFSGSGSGTDFTLTISRLEPEDFAVYYCQ QYAGSPPFTFGQGTKVEIK | |
| BCMA-16 | VH | QVQLQESGPGLVKPSETLSLTCTVSGGSISSSYYYWGWIRQPPGK GLEWIGSIYYSGSAYYNPSLKSRVTISVDTSKNQFSLRLSSVTAAD TAVYYCARHWQEWPDAFDIWGQGTMVTVSS | 306 |
| | VL | ETTLTQSPAFMSATPGDKVIISCKASQDIDDAMNWYQQKPGEAPL FIIQSATSPVPGIPPRFSGSGFGTDFSLTINNIESEDAAYYFCLQHD NFPLTFGQGTKLEIK | 307 |
| | scFv | QVQLQESGPGLVKPSETLSLTCTVSGGSISSSYYYWGWIRQPPGK GLEWIGSIYYSGSAYYNPSLKSRVTISVDTSKNQFSLRLSSVTAAD TAVYYCARHWQEWPDAFDIWGQGTMVTVSSGGGGSGGGGSGG GGSETTLTQSPAFMSATPGDKVIISCKASQDIDDAMNWYQQKPGE APLFIIQSATSPVPGIPPRFSGSGFGTDFSLTINNIESEDAAYYFCLQ HDNFPLTFGQGTKLEIK | 308 |
| BCMA-17 | VH | QVNLRESGPALVKPTQTLTLTCTFSGFSLRTSGMCVSWIRQPPGK ALEWLARIDWDEDKFYSTSLKTRLTISKDTSDNQVVLRMTNMDPA DTATYYCARSGAGGTSATAFDIWGPGTMVTVSS | 309 |
| | VL | DIQMTQSPSSLSASVGDRVTITCRASQDIYNNLAWFQLKPGSAPR SLMYAANKSQSGVPSRFSGSASGTDFTLTISSLQPEDFATYYCQH YYRFPYSFGQGTKLEIK | 310 |
| | scFv | VNLRESGPALVKPTQTLTLTCTFSGFSLRTSGMCVSWIRQPPGKA LEWLARIDWDEDKFYSTSLKTRLTISKDTSDNQVVLRMTNMDPAD TATYYCARSGAGGTSATAFDIWGPGTMVTVSSGGGGSGGGGSG GGGSDIQMTQSPSSLSASVGDRVTITCRASQDIYNNLAWFQLKPG SAPRSLMYAANKSQSGVPSRFSGSASGTDFTLTISSLQPEDFATY YCQHYYRFPYSFGQGTKLEIK | 311 |
| BCMA-18 | VH | EVQLVESGGGLVKPGGSLRLSCAASGFTFSSYSMNWVRQAPGK GLEWVSSISSSSSYIYYADSVKGRFTISRDNAKNSLYLQMNSLRAE DTAVYYCAKTIAAVYAFDIWGQGTTVTVSS | 312 |
| | VL | EIVLTQSPLSLPVTPEEPASISCRSSQSLLHSNGYNYLDWYLQKPG QSPQLLIYLGSNRASGVPDRFSGSGSGTDFTLKISRVEAEDVGVY YCMQALQTPYTFGQGTKLEIK | 313 |
| | scFv | EVQLVESGGGLVKPGGSLRLSCAASGFTFSSYSMNWVRQAPGK GLEWVSSISSSSSYIYYADSVKGRFTISRDNAKNSLYLQMNSLRAE DTAVYYCAKTIAAVYAFDIWGQGTTVTVSSGGGGSGGGGSGGGG SEIVLTQSPLSLPVTPEEPASISCRSSQSLLHSNGYNYLDWYLQKP GQSPQLLIYLGSNRASGVPDRFSGSGSGTDFTLKISRVEAEDVGV YYCMQALQTPYTFGQGTKLEIK | 314 |
| BCMA-19 | VH | EVQLVESGGGLVKPGGSLRLSCAASGFTFSDYYMSWIRQAPGKG LEWVSYISSSGSTIYYADSVKGRFTISRDNAKNSLYLQMNSLRAED TAVYYCARDLRGAFDIWGQGTMVTVSS | 315 |
| | VL | SYVLTQSPSVSAAPGYTATISCGGNNIGTKSVHWYQQKPGQAPLL VIRDDSVRPSKIPGRFSGSNSGNMATLTISGVQAGDEADFYCQVW DSDSEHVVFGGGTKLTVL | 316 |
| | scFv | EVQLVESGGGLVKPGGSLRLSCAASGFTFSDYYMSWIRQAPGKG LEWVSYISSSGSTIYYADSVKGRFTISRDNAKNSLYLQMNSLRAED TAVYYCARDLRGAFDIWGQGTMVTVSSGGGGSGGGGSGGGGSS YVLTQSPSVSAAPGYTATISCGGNNIGTKSVHWYQQKPGQAPLLVI RDDSVRPSKIPGRFSGSNSGNMATLTISGVQAGDEADFYCQVWD SDSEHVVFGGGTKLTVL | 317 |
| BCMA-20 | VH | QVQLVQSGAEVKKPGASVKVSCKPSGYTVTSHYIHWVRRAPGQG LEWMGMINPSGGVTAYSQTLQGRVTMTSDTSSSTVYMELSSLRS EDTAMYYCAREGSGSGWYFDFWGRGTLVTVSS | 318 |
| | VL | SYVLTQPPSVSVSPGQTASITCSGDGLSKKYVSWYQQKAGQSPV VLISRDKERPSGIPDRFSGSNSADTATLTISGTQAMDEADYYCQA WDDTTVVFGGGTKLTVL | 319 |
| | scFv | QVQLVQSGAEVKKPGASVKVSCKPSGYTVTSHYIHWVRRAPGQG LEWMGMINPSGGVTAYSQTLQGRVTMTSDTSSSTVYMELSSLRS EDTAMYYCAREGSGSGWYFDFWGRGTLVTVSSGGGGSGGGGS GGGGSSYVLTQPPSVSVSPGQTASITCSGDGLSKKYVSWYQQKA GQSPVVLISRDKERPSGIPDRFSGSNSADTATLTISGTQAMDEADY YCQAWDDTTVVFGGGTKLTVL | 320 |
| BCMA-21 | VH | QVQLQESGPGLVKPSQTLSLTCTVSGGSISSGGYYWSWIRQHPG KGLEWIGYIYYSGSTYYNPSLKSRVTISVDTSKNQFSLKLSSVTAAD TAVYYCARAGIAARLRGAFDIWGQGTMVTVSS | 321 |

TABLE 15A-continued

BCMA Binders - Variable domain and scFv sequences

| Antibody | Domain | Sequence | SEQ ID NO. |
|---|---|---|---|
| | VL | DIVMTQSPSSVSASVGDRVIITCRASQGIRNWLAWYQQKPGKAPN LLIYAASNLQSGVPSRFSGSGSGADFTLTISSLQPEDVATYYCQKY NSAPFTFGPGTKVDIK | 322 |
| | scFv | QVQLQESGPGLVKPSQTLSLTCTVSGGSISSGGYYWSWIRQHPG KGLEWIGYIYYSGSTYYNPSLKSRVTISVDTSKNQFSLKLSSVTAAD TAVYYCARAGIAARLRGAFDIWGQGTMVTVSSGGGGSGGGGSG GGGSDIVMTQSPSSVSASVGDRVIITCRASQGIRNWLAWYQQKPG KAPNLLIYAASNLQSGVPSRFSGSGSGADFTLTISSLQPEDVATYY CQKYNSAPFTFGPGTKVDIK | 323 |
| BCMA-22 | VH | QVQLVQSGAEVKKPGSSVKVSCKASGGTFSSYAISWVRQAPGQG LEWMGGIIPIFGTANYAQKFQGRVTITADESTSTAYMELSSLRSED TAVYYCARRGGYQLLRWDVGLLRSAFDIWGQGTMVTVSS | 324 |
| | VL | SYVLTQPPSVSVAPGQTARITCGGNNIGSKSVHWYQQKPGQAPV LVLYGKNNRPSGVPDRFSGSRSGTTASLTITGAQAEDEADYYCSS RDSSGDHLRVFGTGTKVTVL | 325 |
| | scFv | QVQLVQSGAEVKKPGSSVKVSCKASGGTFSSYAISWVRQAPGQG LEWMGGIIPIFGTANYAQKFQGRVTITADESTSTAYMELSSLRSED TAVYYCARRGGYQLLRWDVGLLRSAFDIWGQGTMVTVSSGGGG SGGGGSGGGGSSYVLTQPPSVSVAPGQTARITCGGNNIGSKSVH WYQQKPGQAPVLVLYGKNNRPSGVPDRFSGSRSGTTASLTITGA QAEDEADYYCSSRDSSGDHLRVFGTGTKVTVL | 326 |
| BCMA-23 | VH | EVQLQQSGPGLVKPSQTLSLTCAISGDSVSSNSAAWNWIRQSPSR GLEWLGRTYYRSKWYSFYAISLKSRIIINPDTSKNQFSLQLKSVTPE DTAVYYCARSSPEGLFLYWFDPWGQGTLVTVSS | 327 |
| | VL | SSELTQDPAVSVALGQTIRITCQGDSLGNYYATWYQQKPGQAPVL VIYGTNNRPSGIPDRFSASSSGNTASLTITGAQAEDEADYYCNSRD SSGHHLLFGTGTKVTVL | 328 |
| | ScFv | EVQLQQSGPGLVKPSQTLSLTCAISGDSVSSNSAAWNWIRQSPSR GLEWLGRTYYRSKWYSFYAISLKSRIIINPDTSKNQFSLQLKSVTPE DTAVYYCARSSPEGLFLYWFDPWGQGTLVTVSSGGDGSGGGGS GGGGSSSELTQDPAVSVALGQTIRITCQGDSLGNYYATWYQQKP GQAPVLVIYGTNNRPSGIPDRFSASSSGNTASLTITGAQAEDEADY YCNSRDSSGHHLLFGTGTKVTVL | 329 |
| BCMA-24 | VH | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVEGSGSLDYWGQGTLVTVSS | 330 |
| | VL | EIVMTQSPGTLSLSPGERATLSCRASQSVSSAYLAWYQQKPGQP PRLLISGASTRATGIPDRFGGSGSGTDFTLTISRLEPEDFAVYYCQ HYGSSFNGSSLFTFGQGTRLEIK | 331 |
| | scFv | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVEGSGSLDYWGQGTLVTVSSGGGGSGGGGSGG GGSEIVMTQSPGTLSLSPGERATLSCRASQSVSSAYLAWYQQKP GQPPRLLISGASTRATGIPDRFGGSGSGTDFTLTISRLEPEDFAVY YCQHYGSSFNGSSLFTFGQGTRLEIK | 332 |
| | VH | EVQLVETGGGLVQPGGSLRLSCAASGITFSRYPMSWVRQAPGKG LEWVSGISDSGVSTYYADSAKGRFTISRDNSKNTLFLQMSSLRDE DTAVYYCVTRAGSEASDIWGQGTMVTVSS | 333 |
| BCMA-25 | VL | EIVLTQSPATLSLSPGERATLSCRASQSVSNSLAWYQQKPGQAPR LLIYDASSRATGIPDRFSGSGSGTDFTLTISRLEPEDFAIYYCQQFG TSSGLTFGGGTKLEIK | 334 |
| | scFv | EVQLVETGGGLVQPGGSLRLSCAASGITFSRYPMSWVRQAPGKG LEWVSGISDSGVSTYYADSAKGRFTISRDNSKNTLFLQMSSLRDE DTAVYYCVTRAGSEASDIWGQGTMVTVSSGGGGSGGGGSGGG GSEIVLTQSPATLSLSPGERATLSCRASQSVSNSLAWYQQKPGQA PRLLIYDASSRATGIPDRFSGSGSGTDFTLTISRLEPEDFAIYYCQQ FGTSSGLTFGGGTKLEIK | 335 |
| BCMA-26 | VH | QVQLVESGGGLVQPGGSLRLSCAASGFTFSSYAMSWVRQAPGK GLEWVSAISGSGGSTYYADSVKGRFTISRDNAKNSLYLQMNSLRA EDTAIYYCARATYKRELRYYYGMDVWGQGTMVTVSS | 336 |
| | VL | EIVMTQSPGTVSLSPGERATLSCRASQSVSSSFLAWYQQKPGQA PRLLIYGASSRATGIPDRFSGSGSGTDFTLTISRLEPEDSAVYYCQ QYHSSPSVVTFGQGTRLEIK | 337 |
| | scFv | QVQLVESGGGLVQPGGSLRLSCAASGFTFSSYAMSWVRQAPGK GLEWVSAISGSGGSTYYADSVKGRFTISRDNAKNSLYLQMNSLRA EDTAIYYCARATYKRELRYYYGMDVWGQGTMVTVSSGGGGSGG GGSGGGGSEIVMTQSPGTVSLSPGERATLSCRASQSVSSSFLAW YQQKPGQAPRLLIYGASSRATGIPDRFSGSGSGTDFTLTISRLEPE DSAVYYCQQYHSSPSWTFGQGTRLEIK | 338 |

TABLE 15A-continued

BCMA Binders - Variable domain and scFv sequences

| Antibody | Domain | Sequence | SEQ ID NO. |
|---|---|---|---|
| BCMA-27 | VH | EVQLVETGGGLVQPGGSLRLSCAASGFTFSSYAMSWVRQAPGK GLEWVSAISGSGGSTYYADSVKGRFTISRDNSKNTLYLQMNTLKA EDTAVYYCARATYKRELRYYYGMDVWGQGTTVTVSS | 339 |
|  | VL | EIVLTQSPSTLSLSPGESATLSCRASQSVSTTFLAWYQQKPGQAP RLLIYGSSNRATGIPDRFSGSGSGTDFTLTIRRLEPEDFAVYYCQQ YHSSPSWTFGQGTKVEIK | 340 |
|  | scFv | EVQLVETGGGLVQPGGSLRLSCAASGFTFSSYAMSWVRQAPGK GLEWVSAISGSGGSTYYADSVKGRFTISRDNSKNTLYLQMNTLKA EDTAVYYCARATYKRELRYYYGMDVWGQGTTVTVSSGGGGSGG GGSGGGGSEIVLTQSPSTLSLSPGESATLSCRASQSVSTTFLAWY QQKPGQAPRLLIYGSSNRATGIPDRFSGSGSGTDFTLTIRRLEPED FAVYYCQQYHSSPSWTFGQGTKVEIK | 341 |
| BCMA-28 | VH | EVQLVETGGGLVQPGRSLRLSCAASGFTFDDYAMHWVRQAPGK GLEWVSGISWNSGSIGYADSVKGRFTISRDNAKNSLYLQMNSLRD EDTAVYYCARVGKAVPDVWGQGTTVTVSS | 342 |
|  | VL | DIVMTQTPSSLSASVGDRVTITCRASQSISSYLNWYQQKPGKAPKL LIYAASSLQSGVPSRFSGSGSGTDFTLTISSLQPEDFATYYCQQSY STPYSFGQGTRLEIK | 343 |
|  | scFv | EVQLVETGGGLVQPGRSLRLSCAASGFTFDDYAMHWVRQAPGK GLEWVSGISWNSGSIGYADSVKGRFTISRDNAKNSLYLQMNSLRD EDTAVYYCARVGKAVPDVWGQGTTVTVSSGGGGSGGGGSGGG GSDIVMTQTPSSLSASVGDRVTITCRASQSISSYLNWYQQKPGKA PKLLIYAASSLQSGVPSRFSGSGSGTDFTLTISSLQPEDFATYYCQ QSYSTPYSFGQGTRLEIK | 344 |
| BCMA-29 | VH | EVQLVESGGGLVQPGRSLRLSCTASGFTFDDYAMHWVRQRPGK GLEWVASINWKGNSLAYGDSVKGRFAISRDNAKNTVFLQMNSLRT EDTAVYYCASHQGVAYYNYAMDVWGRGTLVTVSS | 345 |
|  | VL | EIVLTQSPGTLSLSPGERATLSCRATQSIGSSFLAWYQQRPGQAP RLLIYGASQRATGIPDRFSGRGSGTDFTLTISRVEPEDSAVYYCQH YESSPSWTFGQGTKVEIK | 346 |
|  | scFv | EVQLVESGGGLVQPGRSLRLSCTASGFTFDDYAMHWVRQRPGK GLEWVASINWKGNSLAYGDSVKGRFAISRDNAKNTVFLQMNSLRT EDTAVYYCASHQGVAYYNYAMDVWGRGTLVTVSSGGGGSGGG GSGGGGSEIVLTQSPGTLSLSPGERATLSCRATQSIGSSFLAWYQ QRPGQAPRLLIYGASQRATGIPDRFSGRGSGTDFTLTISRVEPEDS AVYYCQHYESSPSWTFGQGTKVEIK | 347 |
| BCMA-30 | VH | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVVRDGMDVWGQGTTVTVSS | 348 |
|  | VL | EIVLTQSPATLSLSPGERATLSCRASQSVSSSYLAWYQQKPGQAP RLLIYGASSRATGIPDRFSGNGSGTDFTLTISRLEPEDFAVYYCQQ YGSPPRFTFGPGTKVDIK | 349 |
|  | scFv | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVVRDGMDVWGQGTTVTVSSGGGGSGGGGSGGG GSEIVLTQSPATLSLSPGERATLSCRASQSVSSSYLAWYQQKPGQ APRLLIYGASSRATGIPDRFSGNGSGTDFTLTISRLEPEDFAVYYC QQYGSPPRFTFGPGTKVDIK | 350 |
| BCMA-31 | VH | EVQLLESGGGLVQPGGSLRLSCAASGFTFSSYAMSWVRQAPGKG LEWVSAISGSGGSTYYADSVKGRFTISRDNSKNTLYLQMNSLRAE DTAVYYCAKIPQTGTFDYWGQGTLVTVSS | 351 |
|  | VL | EIVLTQSPGTLSLSPGERATLSCRASQSVSSSYLAWYQQRPGQAP RLLIYGASSRATGIPDRFSGSGSGTDFTLTISRLEPEDFAVYYCQH YGSSPSWTFGQGTRLEIK | 352 |
|  | scFv | EVQLLESGGGLVQPGGSLRLSCAASGFTFSSYAMSWVRQAPGKG LEWVSAISGSGGSTYYADSVKGRFTISRDNSKNTLYLQMNSLRAE DTAVYYCAKIPQTGTFDYWGQGTLVTVSSGGGGSGGGGSGGGG SEIVLTQSPGTLSLSPGERATLSCRASQSVSSSYLAWYQQRPGQA PRLLIYGASSRATGIPDRFSGSGSGTDFTLTISRLEPEDFAVYYCQ HYGSSPSWTFGQGTRLEIK | 353 |
| BCMA-32 | VH | EVQLVETGGGLVQPGGSLRLSCAASGFTFSSYAMSWVRQAPGK GLEWVSAISGSGGSTYYADSVKGRFTMSRENDKNSVFLQMNSLR VEDTGVYYCARANYKRELRYYYGMDVWGQGTMVTVSS | 354 |
|  | VL | EIVMTQSPGTLSLSPGESATLSCRASQRVASNYLAWYQHKPGQA PSLLISGASSRATGVPDRFSGSGSGTDFTLAISRLEPEDSAVYYCQ HYDSSPSWTFGQGTKVEIK | 355 |
|  | scFv | EVQLVETGGGLVQPGGSLRLSCAASGFTFSSYAMSWVRQAPGK GLEWVSAISGSGGSTYYADSVKGRFTMSRENDKNSVFLQMNSLR | 356 |

TABLE 15A-continued

BCMA Binders - Variable domain and scFv sequences

| Antibody | Domain | Sequence | SEQ ID NO. |
|---|---|---|---|
| | | VEDTGVYYCARANYKRELRYYYGMDVWGQGTMVTVSSGGGGS GGGGSGGGGSEIVMTQSPGTLSLSPGESATLSCRASQRVASNYL AWYQHKPGQAPSLLISGASSRATGVPDRFSGSGSGTDFTLAISRL EPEDSAVYYCQHYDSSPSWTFGQGTKVEIK | |
| BCMA-33 | VH | EVQLLETGGGLVQPGGSLRLSCAASGFSFSSYAMSWVRQAPGKG LEWVSAISGSGGSTYYADSVKGRFTISRDNSKNTLYLQMNSLRAE DTAVYYCAKALVGATGAFDIWGQGTLVTVSS | 357 |
| | VL | EIVLTQSPGTLSLSPGERATLSCRASQSLSSNFLAWYQQKPGQAP GLLIYGASNWATGTPDRFSGSGSGTDFTLTITRLEPEDFAVYYCQY YGTSPMYTFGQGTKVEIK | 358 |
| | scFv | EVQLLETGGGLVQPGGSLRLSCAASGFSFSSYAMSWVRQAPGKG LEWVSAISGSGGSTYYADSVKGRFTISRDNSKNTLYLQMNSLRAE DTAVYYCAKALVGATGAFDIWGQGTLVTVSSGGGGSGGGGSGG GGSEIVLTQSPGTLSLSPGERATLSCRASQSLSSNFLAWYQQKPG QAPGLLIYGASNWATGTPDRFSGSGSGTDFTLTITRLEPEDFAVYY CQYYGTSPMYTFGQGTKVEIK | 359 |
| BCMA-34 | VH | EVQLLESGGGLVQPGGSLRLSCAASGFTFSSYAMSWVRQAPGKG LEWVSAISGSGGSTYYADSVKGRFTISRDNSKNTLYLQMNSLRAE DTAVYYCVLWFGEGFDPWGQGTLVTVSS | 360 |
| | VL | DIVLTQSPLSLPVTPGEPASISCRSSQSLLHSNGYNYLDWYLQKPG QSPQLLIYLGSNRASGVPDRFSGSGSGTDFTLKISRVEAEDVGVY YCMQALQTPLTFGGGTKVDIK | 361 |
| | scFv | EVQLLESGGGLVQPGGSLRLSCAASGFTFSSYAMSWVRQAPGKG LEWVSAISGSGGSTYYADSVKGRFTISRDNSKNTLYLQMNSLRAE DTAVYYCVLWFGEGFDPWGQGTLVTVSSGGGGSGGGGSGGGG SDIVLTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPLTFGGGTKVDIK | 362 |
| BCMA-35 | VH | QVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVGYDSSGYYRDYYGMDVWGQGTTVTVSS | 363 |
| | VL | EIVLTQSPGTLSLSPGERATLSCRASQSVSSSYLAWYQQKPGQAP RLLIYGTSSRATGISDRFSGSGSGTDFTLTISRLEPEDFAVYYCQHY GNSPPKFTFGPGTKLEIK | 364 |
| | scFv | QVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKVGYDSSGYYRDYYGMDVWGQGTTVTVSSGGGGS GGGGSGGGGSEIVLTQSPGTLSLSPGERATLSCRASQSVSSSYLA WYQQKPGQAPRLLIYGTSSRATGISDRFSGSGSGTDFTLTISRLEP EDFAVYYCQHYGNSPPKFTFGPGTKLEIK | 365 |
| BCMA-36 | VH | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKMGWSSGYLGAFDIWGQGTTVTVSS | 366 |
| | VL | EIVLTQSPGTLSLSPGERATLSCRASQSVASSFLAWYQQKPGQAP RLLIYGASGRATGIPDRFSGSGSGTDFTLTISRLEPEDFAVYYCQH YGGSPRLTFGGGTKVDIK | 367 |
| | scFv | EVQLVESGGGLVQPGGSLRLSCAASGFTFSSYAMSWVRQAPGK GLEWVSAISGSGGSTYYADSVKGRFTISRDNSKNTLYLQMNSLRA EDTAVYYCAKMGWSSGYLGAFDIWGQGTTVTVSSGGGGSGGGG SGGGGSEIVLTQSPGTLSLSPGERATLSCRASQSVASSFLAWYQQ KPGQAPRLLIYGASGRATGIPDRFSGSGSGTDFTLTISRLEPEDFA VYYCQHYGGSPRLTFGGGTKVDIK | 368 |
| BCMA-37 | VH | QIQLVQSGPDLKKPGETVKLSCKASGYTFTNFGMNWVKQAPGKG FKWMAWINTYTGESYFADDFKGRFAFSVETSATTAYLQINNLKTE DTATYFCARGEIYYGYDGGFAYWGQGTLVTVSA | 369 |
| | VL | DVVMTQSHRFMSTSVGDRVSITCRASQDVNTAVSWYQQKPGQS PKLLIFSASYRYTGVPDRFTGSGSGADFTLTISSVQAEDLAVYYCQ QHYSTPWTFGGGTKLDIK | 370 |
| | scFv | QIQLVQSGPDLKKPGETVKLSCKASGYTFTNFGMNWVKQAPGKG FKWMAWINTYTGESYFADDFKGRFAFSVETSATTAYLQINNLKTE DTATYFCARGEIYYGYDGGFAYWGQGTLVTVSAGGGGSGGGGS GGGGSDVVMTQSHRFMSTSVGDRVSITCRASQDVNTAVSWYQQ KPGQSPKLLIFSASYRYTGVPDRFTGSGSGADFTLTISSVQAEDLA VYYCQQHYSTPWTFGGGTKLDIK | 371 |
| BCMA-38 | VH | QIQLVQSGPELKKPGETVKISCKASGYTFTDYSINWVKRAPGKGLK WMGWINTETREPAYAYDFRGRFAFSLETSASTAYLQINNLKYEDT ATYFCALDYSYAMDYWGQGTSVTVSS | 372 |

TABLE 15A-continued

BCMA Binders - Variable domain and scFv sequences

| Antibody | Domain | Sequence | SEQ ID NO. |
|---|---|---|---|
| | VL | DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK | 373 |
| | scFv | QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS | 374 |
| BCMA-39 | VH | QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS | 375 |
| | VL | DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK | 376 |
| | scFv | QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK | 377 |
| BCMA-40 | VH | QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS | 378 |
| | VL | DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK | 376 |
| | scFv | QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK | 379 |

TABLE 15B

BCMA Binders - Light chain CDR sequences according to Kabat numbering scheme

| Antibody | CDR-L1 | SEQ ID NO: | CDR-L2 | SEQ ID NO: | CDR-L3 | SEQ ID NO: |
|---|---|---|---|---|---|---|
| BCMA-1 | RASQSISSYLN | 380 | AASSLQS | 412 | QQSYSTPYT | 441 |
| BCMA-2 | RASQSISSSFLA | 381 | GASRRAT | 413 | QQYHSSPSWT | 442 |
| BCMA-3 | RSSQSLLHSNGYNYLD | 382 | LGSNRAS | 414 | MQALQTPYT | 443 |
| BCMA-4 | KSSQSLLRNDGKTPLY | 383 | EVSNRFS | 415 | MQNIQFPS | 444 |
| BCMA-5 | RSSQSLLHSNGYNYLN | 384 | LGSKRAS | 416 | MQALQTPYT | 443 |
| BCMA-6 | RASQSISSYLN | 380 | GASTLAS | 417 | QQSYKRAS | 445 |
| BCMA-7 | RSSQSLLYSNGYNYVD | 385 | LGSNRAS | 414 | MQGRQFPYS | 446 |
| BCMA-8 | RASQSVSSNLA | 386 | GASTRAS | 418 | QQYGSSLT | 447 |
| BCMA-9 | RASQSVSSKLA | 387 | GASIRAT | 419 | QQYGSSSWT | 448 |
| BCMA-10 | RASQSVGSTNLA | 388 | DASNRAT | 158 | QQYGSSPPWT | 449 |
| BCMA-11 | RASQSISSYLN | 380 | AASSLQS | 412 | QQSYTLA | 450 |
| BCMA-12 | KSSESLVHNSGKTYLN | 389 | EVSNRDS | 420 | MQGTHWPGT | 451 |
| BCMA-13 | QASEDINKFLN | 390 | DASTLQT | 421 | QQYESLPLT | 452 |
| BCMA-14 | RASQSVGSNLA | 391 | GASTRAT | 422 | QQYNDWLPVT | 453 |

TABLE 15B-continued

BCMA Binders - Light chain CDR sequences according to Kabat numbering scheme

| Antibody | CDR-L1 | SEQ ID NO: | CDR-L2 | SEQ ID NO: | CDR-L3 | SEQ ID NO: |
|---|---|---|---|---|---|---|
| BCMA-15 | RASQSIGSSSLA | 392 | GASSRAS | 423 | QQYAGSPPFT | 454 |
| BCMA-16 | KASQDIDDAMN | 393 | SATSPVP | 424 | LQHDNFPLT | 455 |
| BCMA-17 | RASQDIYNNLA | 394 | AANKSQS | 425 | QHYYRFPYS | 456 |
| BCMA-18 | RSSQSLLHSNGYNYLD | 382 | LGSNRAS | 414 | MQALQTPYT | 443 |
| BCMA-19 | GGNNIGTKSVH | 395 | DDSVRPS | 426 | QVWDSDSEHVV | 457 |
| BCMA-20 | SGDGLSKKYVS | 396 | RDKERPS | 427 | QAWDDTTVV | 458 |
| BCMA-21 | RASQGIRNWLA | 397 | AASNLQS | 428 | QKYNSAPFT | 459 |
| BCMA-22 | GGNNIGSKSVH | 398 | GKNNRPS | 429 | SSRDSSGDHLRV | 460 |
| BCMA-23 | QGDSLGNYYAT | 399 | GTNNRPS | 430 | NSRDSSGHHLL | 461 |
| BCMA-24 | RASQSVSSAYLA | 400 | GASTRAT | 422 | QHYGSSFNGSSLFT | 462 |
| BCMA-25 | RASQSVSNSLA | 401 | DASSRAT | 431 | QQFGTSSGLT | 463 |
| BCMA-26 | RASQSVSSSFLA | 402 | GASSRAT | 432 | QQYHSSPSWT | 442 |
| BCMA-27 | RASQSVSTTFLA | 403 | GSSNRAT | 433 | QQYHSSPSWT | 442 |
| BCMA-28 | RASQSISSYLN | 380 | AASSLQS | 412 | QQSYSTPYS | 464 |
| BCMA-29 | RATQSIGSSFLA | 404 | GASQRAT | 434 | QHYESSPSWT | 465 |
| BCMA-30 | RASQSVSSSYLA | 405 | GASSRAT | 432 | QQYGSPPRFT | 466 |
| BCMA-31 | RASQSVSSSYLA | 405 | GASSRAT | 432 | QHYGSSPSWT | 467 |
| BCMA-32 | RASQRVASNYLA | 406 | GASSRAT | 432 | QHYDSSPSWT | 468 |
| BCMA-33 | RASQSLSSNFLA | 407 | GASNWAT | 435 | QYYGTSPMYT | 469 |
| BCMA-34 | RSSQSLLHSNGYNYLD | 382 | LGSNRAS | 414 | MQALQTPLT | 470 |
| BCMA-35 | RASQSVSSSYLA | 405 | GTSSRAT | 436 | QHYGNSPPKFT | 471 |
| BCMA-36 | RASQSVASSFLA | 408 | GASGRAT | 437 | QHYGGSPRLT | 472 |
| BCMA-37 | RASQDVNTAVS | 409 | SASYRYT | 438 | QQHYSTPWT | 473 |
| BCMA-38 | RASESVSVIGAHLIH | 410 | LASNLET | 439 | LQSRIFPRT | 474 |
| BCMA-39 | RASESVTILGSHLIY | 411 | LASNVQT | 440 | LQSRTIPRT | 475 |
| BCMA-40 | RASESVTILGSHLIY | 411 | LASNVQT | 440 | LQSRTIPRT | 475 |

TABLE 15C

BCMA Binders - Light chain CDR sequences according to Chothia numbering scheme

| Antibody | CDR-L1 | SEQ ID NO: | CDR-L2 | SEQ ID NO: | CDR-L3 | SEQ ID NO: |
|---|---|---|---|---|---|---|
| BCMA-1 | SQSISSY | 476 | AAS | 507 | SYSTPY | 520 |
| BCMA-2 | SQSISSSF | 477 | GAS | 508 | YHSSPSW | 521 |
| BCMA-3 | SQSLLHSNGYNY | 478 | LGS | 509 | ALQTPY | 522 |
| BCMA-4 | SQSLLRNDGKTP | 479 | EVS | 510 | NIQFP | 523 |
| BCMA-5 | SQSLLHSNGYNY | 478 | LGS | 509 | ALQTPY | 522 |
| BCMA-6 | SQSISSY | 476 | GAS | 508 | SYKRA | 524 |
| BCMA-7 | SQSLLYSNGYNY | 480 | LGS | 509 | GRQFPY | 525 |
| BCMA-8 | SQSVSSN | 481 | GAS | 508 | YGSSL | 526 |
| BCMA-9 | SQSVSSK | 482 | GAS | 508 | YGSSSW | 527 |

TABLE 15C-continued

BCMA Binders - Light chain CDR sequences according to Chothia numbering scheme

| Antibody | CDR-L1 | SEQ ID NO: | CDR-L2 | SEQ ID NO: | CDR-L3 | SEQ ID NO: |
|---|---|---|---|---|---|---|
| BCMA-10 | SQSVGSTN | 483 | DAS | 217 | YGSSPPW | 528 |
| BCMA-11 | SQSISSY | 476 | AAS | 507 | SYTL | 529 |
| BCMA-12 | SESLVHNSGKTY | 484 | EVS | 510 | GTHWPG | 530 |
| BCMA-13 | SEDINKF | 485 | DAS | 217 | YESLPL | 531 |
| BCMA-14 | SQSVGSN | 486 | GAS | 508 | YNDWLPV | 532 |
| BCMA-15 | SQSIGSSS | 487 | GAS | 508 | YAGSPPF | 533 |
| BCMA-16 | SQDIDDA | 488 | SAT | 511 | HDNFPL | 534 |
| BCMA-17 | SQDIYNN | 489 | AAN | 512 | YYRFPY | 535 |
| BCMA-18 | SQSLLHSNGYNY | 478 | LGS | 509 | ALQTPY | 522 |
| BCMA-19 | NNIGTKS | 490 | DDS | 513 | WDSDSEHV | 536 |
| BCMA-20 | DGLSKKY | 491 | RDK | 514 | WDDTTV | 537 |
| BCMA-21 | SQGIRNW | 492 | AAS | 507 | YNSAPF | 538 |
| BCMA-22 | NNIGSKS | 493 | GKN | 515 | RDSSGDHLR | 539 |
| BCMA-23 | DSLGNYY | 494 | GTN | 213 | RDSSGHHL | 540 |
| BCMA-24 | SQSVSSAY | 495 | GAS | 508 | YGSSFNGSSLF | 541 |
| BCMA-25 | SQSVSNS | 496 | DAS | 217 | FGTSSGL | 542 |
| BCMA-26 | SQSVSSSF | 497 | GAS | 508 | YHSSPSW | 521 |
| BCMA-27 | SQSVSTTF | 498 | GSS | 516 | YHSSPSW | 521 |
| BCMA-28 | SQSISSY | 476 | AAS | 507 | SYSTPY | 520 |
| BCMA-29 | TQSIGSSF | 499 | GAS | 508 | YESSPSW | 543 |
| BCMA-30 | SQSVSSSY | 500 | GAS | 508 | YGSPPRF | 544 |
| BCMA-31 | SQSVSSSY | 500 | GAS | 508 | YGSSPSW | 545 |
| BCMA-32 | SQRVASNY | 501 | GAS | 508 | YDSSPSW | 546 |
| BCMA-33 | SQSLSSNF | 502 | GAS | 508 | YGTSPMY | 547 |
| BCMA-34 | SQSLLHSNGYNY | 478 | LGS | 509 | ALQTPL | 548 |
| BCMA-35 | SQSVSSSY | 500 | GTS | 517 | YGNSPPKF | 549 |
| BCMA-36 | SQSVASSF | 503 | GAS | 508 | YGGSPRL | 550 |
| BCMA-37 | SQDVNTA | 504 | SAS | 518 | HYSTPW | 551 |
| BCMA-38 | SESVSVIGAHL | 505 | LAS | 519 | SRIFPR | 552 |
| BCMA-39 | SESVTILGSHL | 506 | LAS | 519 | SRTIPR | 553 |
| BCMA-40 | SESVTILGSHL | 506 | LAS | 519 | SRTIPR | 553 |

TABLE 15D

BCMA Binders - Light chain CDR sequences according to combination of Kabat and Chothia numbering schemes

| Antibody | CDR-L1 | SEQ ID NO: | CDR-L2 | SEQ ID NO: | CDR-L3 | SEQ ID NO: |
|---|---|---|---|---|---|---|
| BCMA-1 | RASQSISSYLN | 380 | AASSLQS | 412 | QQSYSTPYT | 441 |
| BCMA-2 | RASQSISSSFLA | 381 | GASRRAT | 413 | QQYHSSPSWT | 442 |
| BCMA-3 | RSSQSLLHSNGYNYLD | 382 | LGSNRAS | 414 | MQALQTPYT | 443 |
| BCMA-4 | KSSQSLLRNDGKTPLY | 383 | EVSNRFS | 415 | MQNIQFPS | 444 |
| BCMA-5 | RSSQSLLHSNGYNYLN | 384 | LGSKRAS | 416 | MQALQTPYT | 443 |
| BCMA-6 | RASQSISSYLN | 380 | GASTLAS | 417 | QQSYKRAS | 445 |
| BCMA-7 | RSSQSLLYSNGYNYVD | 385 | LGSNRAS | 414 | MQGRQFPYS | 446 |
| BCMA-8 | RASQSVSSNLA | 386 | GASTRAS | 418 | QQYGSSLT | 447 |
| BCMA-9 | RASQSVSSKLA | 387 | GASIRAT | 419 | QQYGSSSWT | 448 |
| BCMA-10 | RASQSVGSTNLA | 388 | DASNRAT | 158 | QQYGSSPPWT | 449 |
| BCMA-11 | RASQSISSYLN | 380 | AASSLQS | 412 | QQSYTLA | 450 |
| BCMA-12 | KSSESLVHNSGKTYLN | 389 | EVSNRDS | 420 | MQGTHWPGT | 451 |

TABLE 15D-continued

BCMA Binders - Light chain CDR sequences according to combination of Kabat and Chothia numbering schemes

| Antibody | CDR-L1 | SEQ ID NO: | CDR-L2 | SEQ ID NO: | CDR-L3 | SEQ ID NO: |
|---|---|---|---|---|---|---|
| BCMA-13 | QASEDINKFLN | 390 | DASTLQT | 421 | QQYESLPLT | 452 |
| BCMA-14 | RASQSVGSNLA | 391 | GASTRAT | 422 | QQYNDWLPVT | 453 |
| BCMA-15 | RASQSIGSSSLA | 392 | GASSRAS | 423 | QQYAGSPPFT | 454 |
| BCMA-16 | KASQDIDDAMN | 393 | SATSPVP | 424 | LQHDNFPLT | 455 |
| BCMA-17 | RASQDIYNNLA | 394 | AANKSQS | 425 | QHYYRFPYS | 456 |
| BCMA-18 | RSSQSLLHSNGYNYLD | 382 | LGSNRAS | 414 | MQALQTPYT | 443 |
| BCMA-19 | GGNNIGTKSVH | 395 | DDSVRPS | 426 | QVWDSDSEHVV | 457 |
| BCMA-20 | SGDGLSKKYVS | 396 | RDKERPS | 427 | QAWDDTTVV | 458 |
| BCMA-21 | RASQGIRNWLA | 397 | AASNLQS | 428 | QKYNSAPFT | 459 |
| BCMA-22 | GGNNIGSKSVH | 398 | GKNNRPS | 429 | SSRDSSGDHLRV | 460 |
| BCMA-23 | QGDSLGNYYAT | 399 | GTNNRPS | 430 | NSRDSSGHHLL | 461 |
| BCMA-24 | RASQSVSSAYLA | 400 | GASTRAT | 422 | QHYGSSFNGSSLFT | 462 |
| BCMA-25 | RASQSVSNSLA | 401 | DASSRAT | 431 | QQFGTSSGLT | 463 |
| BCMA-26 | RASQSVSSSFLA | 402 | GASSRAT | 432 | QQYHSSPSWT | 442 |
| BCMA-27 | RASQSVSTTFLA | 403 | GSSNRAT | 433 | QQYHSSPSWT | 442 |
| BCMA-28 | RASQSISSYLN | 380 | AASSLQS | 412 | QQSYSTPYS | 464 |
| BCMA-29 | RATQSIGSSFLA | 404 | GASQRAT | 434 | QHYESSPSWT | 465 |
| BCMA-30 | RASQSVSSSYLA | 405 | GASSRAT | 432 | QQYGSPPRFT | 466 |
| BCMA-31 | RASQSVSSSYLA | 405 | GASSRAT | 432 | QHYGSSPSWT | 467 |
| BCMA-32 | RASQRVASNYLA | 406 | GASSRAT | 432 | QHYDSSPSWT | 468 |
| BCMA-33 | RASQSLSSNFLA | 407 | GASNWAT | 435 | QYYGTSPMYT | 469 |
| BCMA-34 | RSSQSLLHSNGYNYLD | 382 | LGSNRAS | 414 | MQALQTPLT | 470 |
| BCMA-35 | RASQSVSSSYLA | 405 | GTSSRAT | 436 | QHYGNSPPKFT | 471 |
| BCMA-36 | RASQSVASSFLA | 408 | GASGRAT | 437 | QHYGGSPRLT | 472 |
| BCMA-37 | RASQDVNTAVS | 409 | SASYRYT | 438 | QQHYSTPWT | 473 |
| BCMA-38 | RASESVSVIGAHLIH | 410 | LASNLET | 439 | LQSRIFPRT | 474 |
| BCMA-39 | RASESVTILGSHLIY | 411 | LASNVQT | 440 | LQSRTIPRT | 475 |
| BCMA-40 | RASESVTILGSHLIY | 411 | LASNVQT | 440 | LQSRTIPRT | 475 |

TABLE 15E

BCMA Binders-Heavy chain CDR sequences according to Kabat numbering scheme

| Antibody | CDR-H1 | SEQ ID NO: | CDR-H2 | SEQ ID NO: | CDR-H3 | SEQ ID NO: |
|---|---|---|---|---|---|---|
| BCMA-1 | NHGMS | 554 | GIVYSGSTYYAASVKG | 573 | HGGESDV | 595 |
| BCMA-2 | NYAMS | 555 | GISRSGENTYYADSVKG | 574 | SPAHYYGGMDV | 596 |
| BCMA-3 | DYAMH | 556 | GISWNSGSIGYADSVKG | 575 | HSFLAY | 597 |
| BCMA-4 | NHGMS | 554 | GIVYSGSTYYAASVKG | 573 | HGGESDV | 595 |
| BCMA-5 | NFGIN | 557 | WINPKNNNTNYAQKFQG | 576 | GPYYYQSYMDV | 598 |
| BCMA-6 | SDAMT | 558 | VISGSGGTTYYADSVKG | 577 | LDSSGYYYARGPRY | 599 |
| BCMA-7 | NYGIT | 559 | WISAYNGNTNYAQKFQG | 578 | GPYYYMDV | 600 |
| BCMA-8 | NHGMS | 554 | GIVYSGSTYYAASVKG | 573 | HGGESDV | 595 |
| BCMA-9 | NHGMS | 554 | GIVYSGSTYYAASVKG | 573 | HGGESDV | 595 |
| BCMA-10 | NHGMS | 554 | GIVYSGSTYYAASVKG | 573 | HGGESDV | 595 |
| BCMA-11 | DYYMS | 560 | YISSSGSTIYYADSVKG | 579 | ESGDGMDV | 601 |
| BCMA-12 | DYYMS | 560 | YISSSGNTIYYADSVKG | 580 | STMVREDY | 602 |
| BCMA-13 | NHGMS | 554 | GIVYSGSTYYAASVKG | 573 | HGGESDV | 595 |
| BCMA-14 | NHGMS | 554 | GIVYSGSTYYAASVKG | 573 | HGGESDV | 595 |
| BCMA-15 | NHGMS | 554 | GIVYSGSTYYAASVKG | 573 | HGGESDV | 595 |
| BCMA-16 | SSYYWG | 561 | SIYYSGSAYYNPSLKS | 581 | HWQEWPDAFDI | 603 |
| BCMA-17 | TSGMCVS | 562 | RIDWDEDKFYSTSLKT | 582 | SGAGGTSATAFDI | 604 |
| BCMA-18 | SYSMN | 563 | SISSSSSYIYYADSVKG | 583 | TIAAVYAFDI | 605 |
| BCMA-19 | DYYMS | 560 | YISSSGSTIYYADSVKG | 579 | DLRGAFDI | 606 |
| BCMA-20 | SHYIH | 564 | MINPSGGVTAYSQTLQG | 584 | EGSGSGWYFDF | 607 |
| BCMA-21 | SGGYYWS | 565 | YIYYSGSTYYNPSLKS | 585 | AGIAARLRGAFDI | 608 |
| BCMA-22 | SYAIS | 566 | GIIPIFGTANYAQKFQG | 586 | RGGYQLLRWDVGLLRSAFDI | 609 |
| BCMA-23 | SNSAAWN | 567 | RTYYRSKWYSFYAISLKS | 587 | SSPEGLFLYWFDP | 610 |
| BCMA-24 | SYAMS | 568 | AISGSGGSTYYADSVKG | 588 | VEGSGSLDY | 611 |
| BCMA-25 | RYPMS | 569 | GISDSGVSTYYADSAKG | 589 | RAGSEASDI | 612 |

TABLE 15E-continued

BCMA Binders-Heavy chain CDR sequences according to Kabat numbering scheme

| Antibody | CDR-H1 | SEQ ID NO: | CDR-H2 | SEQ ID NO: | CDR-H3 | SEQ ID NO: |
|---|---|---|---|---|---|---|
| BCMA-26 | SYAMS | 568 | AISGSGGSTYYADSVKG | 588 | ATYKRELRYYYGMDV | 613 |
| BCMA-27 | SYAMS | 568 | AISGSGGSTYYADSVKG | 588 | ATYKRELRYYYGMDV | 613 |
| BCMA-28 | DYAMH | 556 | GISWNSGSIGYADSVKG | 575 | VGKAVPDV | 614 |
| BCMA-29 | DYAMH | 556 | SINWKGNSLAYGDSVKG | 590 | HQGVAYYNYAMDV | 615 |
| BCMA-30 | SYAMS | 568 | AISGSGGSTYYADSVKG | 588 | VVRDGMDV | 616 |
| BCMA-31 | SYAMS | 568 | AISGSGGSTYYADSVKG | 588 | IPQTGTFDY | 617 |
| BCMA-32 | SYAMS | 568 | AISGSGGSTYYADSVKG | 588 | ANYKRELRYYYGMDV | 618 |
| BCMA-33 | SYAMS | 568 | AISGSGGSTYYADSVKG | 588 | ALVGATGAFDI | 619 |
| BCMA-34 | SYAMS | 568 | AISGSGGSTYYADSVKG | 588 | WFGEGFDP | 620 |
| BCMA-35 | SYAMS | 568 | AISGSGGSTYYADSVKG | 588 | VGYDSSGYYRDYYGMDV | 621 |
| BCMA-36 | SYAMS | 568 | AISGSGGSTYYADSVKG | 588 | MGWSSGYLGAFDI | 622 |
| BCMA-37 | NFGMN | 570 | WINTYTGESYFADDFKG | 591 | GEIYYGYDGGFAY | 623 |
| BCMA-38 | DYSIN | 571 | WINTETREPAYAYDFRG | 592 | DYSYAMDY | 624 |
| BCMA-39 | HYSMN | 572 | RINTESGVPIYADDFKG | 593 | DYLYSLDF | 625 |
| BCMA-40 | HYSMN | 572 | RINTETGEPLYADDFKG | 594 | DYLYSCDY | 626 |

TABLE 15F

BCMA Binders - Heavy chain CDR sequences according to Chothia numbering scheme

| Antibody | CDR-H1 | SEQ ID NO: | CDR-H2 | SEQ ID NO: | CDR-H3 | SEQ ID NO: |
|---|---|---|---|---|---|---|
| BCMA-1 | GFALSNH | 627 | VYSGS | 647 | HGGESDV | 595 |
| BCMA-2 | GFTFSNY | 628 | SRSGEN | 648 | SPAHYYGGMDV | 596 |
| BCMA-3 | GFTFDDY | 629 | SWNSGS | 649 | HSFLAY | 597 |
| BCMA-4 | GFALSNH | 627 | VYSGS | 647 | HGGESDV | 595 |
| BCMA-5 | GYIFDNF | 630 | NPKNNN | 650 | GPYYYQSYMDV | 598 |
| BCMA-6 | GFTFSSD | 631 | SGSGGT | 651 | LDSSGYYYARGPRY | 599 |
| BCMA-7 | GYTFSNY | 632 | SAYNGN | 652 | GPYYYMDV | 600 |
| BCMA-8 | GFALSNH | 627 | VYSGS | 647 | HGGESDV | 595 |
| BCMA-9 | GFALSNH | 627 | VYSGS | 647 | HGGESDV | 595 |
| BCMA-10 | GFALSNH | 627 | VYSGS | 647 | HGGESDV | 595 |
| BCMA-11 | GFTFSDY | 633 | SSSGST | 653 | ESGDGMDV | 601 |
| BCMA-12 | GFTFSDY | 633 | SSSGNT | 654 | STMVREDY | 602 |
| BCMA-13 | GFALSNH | 627 | VYSGS | 647 | HGGESDV | 595 |
| BCMA-14 | GFALSNH | 627 | VYSGS | 647 | HGGESDV | 595 |
| BCMA-15 | GFALSNH | 627 | VYSGS | 647 | HGGESDV | 595 |
| BCMA-16 | GGSISSSYY | 634 | YYSGS | 655 | HWQEWPDAFDI | 603 |

TABLE 15F-continued

BCMA Binders - Heavy chain CDR sequences according to Chothia numbering scheme

| Antibody | CDR-H1 | SEQ ID NO: | CDR-H2 | SEQ ID NO: | CDR-H3 | SEQ ID NO: |
|---|---|---|---|---|---|---|
| BCMA-17 | GFSLRTSGM | 635 | DWDED | 656 | SGAGGTSATAFDI | 604 |
| BCMA-18 | GFTFSSY | 636 | SSSSSY | 657 | TIAAVYAFDI | 605 |
| BCMA-19 | GFTFSDY | 633 | SSSGST | 653 | DLRGAFDI | 606 |
| BCMA-20 | GYTVTSH | 637 | NPSGGV | 658 | EGSGSGWYFDF | 607 |
| BCMA-21 | GGSISSGGY | 638 | YYSGS | 655 | AGIAARLRGAFDI | 608 |
| BCMA-22 | GGTFSSY | 639 | IPIFGT | 659 | RGGYQLLRWDVGLLRSAFDI | 609 |
| BCMA-23 | GDSVSSNSA | 640 | YYRSKWY | 660 | SSPEGLFLYWFDP | 610 |
| BCMA-24 | GFTFSSY | 636 | SGSGGS | 661 | VEGSGSLDY | 611 |
| BCMA-25 | GITFSRY | 641 | SDSGVS | 662 | RAGSEASDI | 612 |
| BCMA-26 | GFTFSSY | 636 | SGSGGS | 661 | ATYKRELRYYYGMDV | 613 |
| BCMA-27 | GFTFSSY | 636 | SGSGGS | 661 | ATYKRELRYYYGMDV | 613 |
| BCMA-28 | GFTFDDY | 629 | SWNSGS | 649 | VGKAVPDV | 614 |
| BCMA-29 | GFTFDDY | 629 | NWKGNS | 663 | HQGVAYYNYAMDV | 615 |
| BCMA-30 | GFTFSSY | 636 | SGSGGS | 661 | VVRDGMDV | 616 |
| BCMA-31 | GFTFSSY | 636 | SGSGGS | 661 | IPQTGTFDY | 617 |
| BCMA-32 | GFTFSSY | 636 | SGSGGS | 661 | ANYKRELRYYYGMDV | 618 |
| BCMA-33 | GFSFSSY | 642 | SGSGGS | 661 | ALVGATGAFDI | 619 |
| BCMA-34 | GFTFSSY | 636 | SGSGGS | 661 | WFGEGFDP | 620 |
| BCMA-35 | GFTFSSY | 636 | SGSGGS | 661 | VGYDSSGYYRDYYGMDV | 621 |
| BCMA-36 | GFTFSSY | 636 | SGSGGS | 661 | MGWSSGYLGAFDI | 622 |
| BCMA-37 | GYTFTNF | 643 | NTYTGE | 664 | GEIYYGYDGGFAY | 623 |
| BCMA-38 | GYTFTDY | 644 | NTETRE | 665 | DYSYAMDY | 624 |
| BCMA-39 | GYTFRHY | 645 | NTESGV | 666 | DYLYSLDF | 625 |
| BCMA-40 | GYTFTHY | 646 | NTETGE | 667 | DYLYSCDY | 626 |

TABLE 15G

BCMA Binders - Heavy chain CDR sequences according to combination of Kabat and Chothia numbering schemes

| Antibody | CDR-H1 | SEQ ID NO: | CDR-H2 | SEQ ID NO: | CDR-H3 | SEQ ID NO: |
|---|---|---|---|---|---|---|
| BCMA-1 | GFALSNHGMS | 668 | GIVYSGSTYYAASVKG | 573 | HGGESDV | 595 |
| BCMA-2 | GFTFSNYAMS | 669 | GISRSGENTYYADSVKG | 574 | SPAHYYGGMDV | 596 |
| BCMA-3 | GFTFDDYAMH | 670 | GISWNSGSIGYADSVKG | 575 | HSFLAY | 597 |
| BCMA-4 | GFALSNHGMS | 668 | GIVYSGSTYYAASVKG | 573 | HGGESDV | 595 |
| BCMA-5 | GYIFDNFGIN | 671 | WINPKNNNTNYAQKFQG | 576 | GPYYYQSYMDV | 598 |
| BCMA-6 | GFTFSSDAMT | 672 | VISGSGGTTYYADSVKG | 577 | LDSSGYYYARGPRY | 599 |
| BCMA-7 | GYTFSNYGIT | 673 | WISAYNGNTNYAQKFQG | 578 | GPYYYMDV | 600 |
| BCMA-8 | GFALSNHGMS | 668 | GIVYSGSTYYAASVKG | 573 | HGGESDV | 595 |
| BCMA-9 | GFALSNHGMS | 668 | GIVYSGSTYYAASVKG | 573 | HGGESDV | 595 |
| BCMA-10 | GFALSNHGMS | 668 | GIVYSGSTYYAASVKG | 573 | HGGESDV | 595 |
| BCMA-11 | GFTFSDYYMS | 674 | YISSSGSTIYYADSVKG | 579 | ESGDGMDV | 601 |

TABLE 15G-continued

BCMA Binders - Heavy chain CDR sequences according to combination of Kabat and Chothia numbering schemes

| Antibody | CDR-H1 | SEQ ID NO: | CDR-H2 | SEQ ID NO: | CDR-H3 | SEQ ID NO: |
|---|---|---|---|---|---|---|
| BCMA-12 | GFTFSDYYMS | 674 | YISSSGNTIYYADSVKG | 580 | STMVREDY | 602 |
| BCMA-13 | GFALSNHGMS | 668 | GIVYSGSTYYAASVKG | 573 | HGGESDV | 595 |
| BCMA-14 | GFALSNHGMS | 668 | GIVYSGSTYYAASVKG | 573 | HGGESDV | 595 |
| BCMA-15 | GFALSNHGMS | 668 | GIVYSGSTYYAASVKG | 573 | HGGESDV | 595 |
| BCMA-16 | GGSISSSYYYWG | 675 | SIYYSGSAYYNPSLKS | 581 | HWQEWPDAFDI | 603 |
| BCMA-17 | GFSLRTSGMCVS | 676 | RIDWDEDKFYSTSLKT | 582 | SGAGGTSATAFDI | 604 |
| BCMA-18 | GFTFSSYSMN | 677 | SISSSSSYIYYADSVKG | 583 | TIAAVYAFDI | 605 |
| BCMA-19 | GFTFSDYYMS | 674 | YISSSGSTIYYADSVKG | 579 | DLRGAFDI | 606 |
| BCMA-20 | GYTVTSHYIH | 678 | MINPSGGVTAYSQTLQG | 584 | EGSGSGWYFDF | 607 |
| BCMA-21 | GGSISSGGYYWS | 679 | YIYYSGSTYYNPSLKS | 585 | AGIAARLRGAFDI | 608 |
| BCMA-22 | GGTFSSYAIS | 680 | GIIPIFGTANYAQKFQG | 586 | RGGYQLLRWDVGLLRSAFDI | 609 |
| BCMA-23 | GDSVSSNSAAWN | 681 | RTYYRSKWYSFYAISLKS | 587 | SSPEGLFLYWFDP | 610 |
| BCMA-24 | GFTFSSYAMS | 682 | AISGSGGSTYYADSVKG | 588 | VEGSGSLDY | 611 |
| BCMA-25 | GITFSRYPMS | 683 | GISDSGVSTYYADSAKG | 589 | RAGSEASDI | 612 |
| BCMA-26 | GFTFSSYAMS | 682 | AISGSGGSTYYADSVKG | 588 | ATYKRELRYYYGMDV | 613 |
| BCMA-27 | GFTFSSYAMS | 682 | AISGSGGSTYYADSVKG | 588 | ATYKRELRYYYGMDV | 613 |
| BCMA-28 | GFTFDDYAMH | 670 | GISWNSGSIGYADSVKG | 575 | VGKAVPDV | 614 |
| BCMA-29 | GFTFDDYAMH | 670 | SINWKGNSLAYGDSVKG | 590 | HQGVAYYNYAMDV | 615 |
| BCMA-30 | GFTFSSYAMS | 682 | AISGSGGSTYYADSVKG | 588 | VVRDGMDV | 616 |
| BCMA-31 | GFTFSSYAMS | 682 | AISGSGGSTYYADSVKG | 588 | IPQTGTFDY | 617 |
| BCMA-32 | GFTFSSYAMS | 682 | AISGSGGSTYYADSVKG | 588 | ANYKRELRYYYGMDV | 618 |
| BCMA-33 | GFSFSSYAMS | 684 | AISGSGGSTYYADSVKG | 588 | ALVGATGAFDI | 619 |
| BCMA-34 | GFTFSSYAMS | 682 | AISGSGGSTYYADSVKG | 588 | WFGEGFDP | 620 |
| BCMA-35 | GFTFSSYAMS | 682 | AISGSGGSTYYADSVKG | 588 | VGYDSSGYYRDYYGMDV | 621 |

TABLE 15G-continued

BCMA Binders - Heavy chain CDR sequences according to combination of Kabat and Chothia numbering schemes

| Antibody | CDR-H1 | SEQ ID NO: | CDR-H2 | SEQ ID NO: | CDR-H3 | SEQ ID NO: |
|---|---|---|---|---|---|---|
| BCMA-36 | GFTFSSYAMS | 682 | AISGSGGSTYYADSVKG | 588 | MGWSSGYLGAFDI | 622 |
| BCMA-37 | GYTFTNFGMN | 685 | WINTYTGESYFADDFKG | 591 | GEIYYGYDGGFAY | 623 |
| BCMA-38 | GYTFTDYSIN | 686 | WINTETREPAYAYDFRG | 592 | DYSYAMDY | 624 |
| BCMA-39 | GYTFRHYSMN | 687 | RINTESGVPIYADDFKG | 593 | DYLYSLDF | 625 |
| BCMA-40 | GYTFTHYSMN | 688 | RINTETGEPLYADDFKG | 594 | DYLYSCDY | 626 |

In some embodiments, the ABM comprises the CDR sequences of BCMA-1. In some embodiments, the ABM comprises the CDR sequences of BCMA-2. In some embodiments, the ABM comprises the CDR sequences of BCMA-3. In some embodiments, the ABM comprises the CDR sequences of BCMA-4. In some embodiments, the ABM comprises the CDR sequences of BCMA-5. In some embodiments, the ABM comprises the CDR sequences of BCMA-6. In some embodiments, the ABM comprises the CDR sequences of BCMA-7. In some embodiments, the ABM comprises the CDR sequences of BCMA-8. In some embodiments, the ABM comprises the CDR sequences of BCMA-9. In some embodiments, the ABM comprises the CDR sequences of BCMA-10. In some embodiments, the ABM comprises the CDR sequences of BCMA-11. In some embodiments, the ABM comprises the CDR sequences of BCMA-12. In some embodiments, the ABM comprises the CDR sequences of BCMA-13. In some embodiments, the ABM comprises the CDR sequences of BCMA-14. In some embodiments, the ABM comprises the CDR sequences of BCMA-15. In some embodiments, the ABM comprises the CDR sequences of BCMA-16. In some embodiments, the ABM comprises the CDR sequences of BCMA-17. In some embodiments, the ABM comprises the CDR sequences of BCMA-18. In some embodiments, the ABM comprises the CDR sequences of BCMA-19. In some embodiments, the ABM comprises the CDR sequences of BCMA-20. In some embodiments, the ABM comprises the CDR sequences of BCMA-21. In some embodiments, the ABM comprises the CDR sequences of BCMA-22. In some embodiments, the ABM comprises the CDR sequences of BCMA-23. In some embodiments, the ABM comprises the CDR sequences of BCMA-24. In some embodiments, the ABM comprises the CDR sequences of BCMA-25. In some embodiments, the ABM comprises the CDR sequences of BCMA-26. In some embodiments, the ABM comprises the CDR sequences of BCMA-27. In some embodiments, the ABM comprises the CDR sequences of BCMA-28. In some embodiments, the ABM comprises the CDR sequences of BCMA-29. In some embodiments, the ABM comprises the CDR sequences of BCMA-30. In some embodiments, the ABM comprises the CDR sequences of BCMA-31. In some embodiments, the ABM comprises the CDR sequences of BCMA-32. In some embodiments, the ABM comprises the CDR sequences of BCMA-33. In some embodiments, the ABM comprises the CDR sequences of BCMA-34. In some embodiments, the ABM comprises the CDR sequences of BCMA-35. In some embodiments, the ABM comprises the CDR sequences of BCMA-36. In some embodiments, the ABM comprises the CDR sequences of BCMA-37. In some embodiments, the ABM comprises the CDR sequences of BCMA-38. In some embodiments, the ABM comprises the CDR sequences of BCMA-39. In some embodiments, the ABM comprises the CDR sequences of BCMA-40.

In some embodiments, the CDRs are defined by Kabat numbering, as set forth in Tables 15B and 15E. In other embodiments, the CDRs are defined by Chothia numbering, as set forth in Tables 15C and 15F. In yet other embodiments, the CDRs are defined by a combination of Kabat and Chothia numbering, as set forth in Tables 15D and 15G.

In some embodiments, the TBMs comprising an ABM3 that binds to BCMA can comprise the heavy and light chain variable sequences of any of BCMA-1 to BCMA-40.

In some embodiments, ABM3 comprises the heavy and light chain variable sequences of BCMA-1, as set forth in Table 15A. In some embodiments, the ABM comprises the heavy and light chain variable sequences of BCMA-2, as set forth in Table 15A. In some embodiments, the ABM comprises the heavy and light chain variable sequences of BCMA-3, as set forth in Table 15A. In some embodiments, the ABM comprises the heavy and light chain variable sequences of BCMA-4, as set forth in Table 15A. In some embodiments, the ABM comprises the heavy and light chain variable sequences of BCMA-5, as set forth in Table 15A. In some embodiments, the ABM comprises the heavy and light chain variable sequences of BCMA-6, as set forth in Table 15A. In some embodiments, the ABM comprises the heavy and light chain variable sequences of BCMA-7, as set forth in Table 15A. In some embodiments, the ABM comprises the heavy and light chain variable sequences of BCMA-8, as set forth in Table 15A. In some embodiments, the ABM comprises the heavy and light chain variable sequences of BCMA-9, as set forth in Table 15A. In some embodiments, the ABM comprises the heavy and light chain variable sequences of BCMA-10, as set forth in Table 15A. In some embodiments, the ABM comprises the heavy and light chain variable sequences of BCMA-11, as set forth in Table 15A. In some embodiments, the ABM comprises the heavy and light chain variable sequences of BCMA-12, as set forth in Table 15A. In some embodiments, the ABM comprises the heavy and light chain variable sequences of BCMA-13, as set forth in Table 15A.

In some embodiments, the ABM comprises the heavy and light chain variable sequences of BCMA-14, as set forth in Table 15A. In some embodiments, the ABM comprises the heavy and light chain variable sequences of BCMA-15, as set forth in Table 15A. In some embodiments, the ABM comprises the heavy and light chain variable sequences of BCMA-16, as set forth in Table 15A. In some embodiments, the ABM comprises the heavy and light chain variable sequences of BCMA-17, as set forth in Table 15A. In some embodiments, the ABM comprises the heavy and light chain variable sequences of BCMA-18, as set forth in Table 15A. In some embodiments, the ABM comprises the heavy and light chain variable sequences of BCMA-19, as set forth in Table 15A. In some embodiments, the ABM comprises the heavy and light chain variable sequences of BCMA-20, as set forth in Table 15A. In some embodiments, the ABM comprises the heavy and light chain variable sequences of BCMA-21, as set forth in Table 15A. In some embodiments, the ABM comprises the heavy and light chain variable sequences of BCMA-22, as set forth in Table 15A.

In some embodiments, the ABM comprises the heavy and light chain variable sequences of BCMA-23, as set forth in Table 15A. In some embodiments, the ABM comprises the heavy and light chain variable sequences of BCMA-24, as set forth in Table 15A. In some embodiments, the ABM comprises the heavy and light chain variable sequences of BCMA-25, as set forth in Table 15A. In some embodiments, the ABM comprises the heavy and light chain variable sequences of BCMA-26, as set forth in Table 15A. In some embodiments, the ABM comprises the heavy and light chain variable sequences of BCMA-27, as set forth in Table 15A. In some embodiments, the ABM comprises the heavy and light chain variable sequences of BCMA-28, as set forth in Table 15A. In some embodiments, the ABM comprises the heavy and light chain variable sequences of BCMA-29, as set forth in Table 15A. In some embodiments, the ABM comprises the heavy and light chain variable sequences of BCMA-30, as set forth in Table 15A. In some embodiments, the ABM comprises the heavy and light chain variable sequences of BCMA-31, as set forth in Table 15A. In some embodiments, the ABM comprises the heavy and light chain variable sequences of BCMA-32, as set forth in Table 15A. In some embodiments, the ABM comprises the heavy and light chain variable sequences of BCMA-33, as set forth in Table 15A. In some embodiments, the ABM comprises the heavy and light chain variable sequences of BCMA-34, as set forth in Table 15A. In some embodiments, the ABM comprises the heavy and light chain variable sequences of BCMA-35, as set forth in Table 15A. In some embodiments, the ABM comprises the heavy and light chain variable sequences of BCMA-36, as set forth in Table 15A. In some embodiments, the ABM comprises the heavy and light chain variable sequences of BCMA-37, as set forth in Table 15A. In some embodiments, the ABM comprises the heavy and light chain variable sequences of BCMA-38, as set forth in Table 15A. In some embodiments, the ABM comprises the heavy and light chain variable sequences of BCMA-39, as set forth in Table 15A. In some embodiments, the ABM comprises the heavy and light chain variable sequences of BCMA-40, as set forth in Table 15A.

7.10.2. CD19

B cells express cell surface proteins which can be utilized as markers for differentiation and identification. One such human B-cell marker is a CD19 antigen and is found on mature B cells but not on plasma cells. CD19 is expressed during early pre-B cell development and remains until plasma cell differentiation. CD19 is expressed on both normal B cells and malignant B cells whose abnormal growth can lead to B-cell lymphomas. For example, CD19 is expressed on B-cell lineage malignancies, including, but not limited to non-Hodgkin's lymphoma (B-NHL), chronic lymphocytic leukemia, and acute lymphoblastic leukemia.

In certain aspects, a MBM of the disclosure comprises an ABM2 or ABM3 that specifically binds to CD19. Exemplary CDR and variable domain sequences that can be incorporated into an ABM2 or ABM3 that specifically binds to CD19 are set forth in Table 16 below.

TABLE 16

CD19 Binders

| Name | Domain | Sequence | SEQ ID NO: |
|---|---|---|---|
| CD19-H1 | CDR-H1 | DYGVS | 689 |
| CD19-H2A | CDR-H2 | VIWGSETTYYNSALKS | 690 |
| CD19-H2B | CDR-H2 | VIWGSETTYYSSSLKS | 691 |
| CD19-H2C | CDR-H2 | VIWGSETTYYQSSLKS | 692 |
| CD19-H2D | CDR-H2 | VIWGSETTYYNSSLKS | 693 |
| CD19-H3 | CDR-H3 | HYYYGGSYAMDY | 694 |
| CD19-L1 | CDR-L1 | RASQDISKYLN | 695 |
| CD19-L2 | CDR-L2 | HTSRLHS | 696 |
| CD19-L3 | CDR-L3 | QQGNTLPYT | 697 |
| CD19-VHA | VH | EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS | 698 |

TABLE 16-continued

CD19 Binders

| Name | Domain | Sequence | SEQ ID NO: |
| --- | --- | --- | --- |
| CD19-VHB | VH | QVQLQESGPGLVKPSETLSLTCTVSGVSLPDYGVSWIR QPPGKGLEWIGVIWGSETTYYSSSLKSRVTISKDNSKN QVSLKLSSVTAADTAVYYCAKHYYYGGSYAMDYWGQ GTLVTVSS | 699 |
| CD19-VHC | VH | QVQLQESGPGLVKPSETLSLTCTVSGVSLPDYGVSWIR QPPGKGLEWIGVIWGSETTYYQSSLKSRVTISKDNSKN QVSLKLSSVTAADTAVYYCAKHYYYGGSYAMDYWGQ GTLVTVSS | 700 |
| CD19-VHD | VH | QVQLQESGPGLVKPSETLSLTCTVSGVSLPDYGVSWIR QPPGKGLEWIGVIWGSETTYYNSSLKSRVTISKDNSKN QVSLKLSSVTAADTAVYYCAKHYYYGGSYAMDYWGQ GTLVTVSS | 701 |
| CD19-VLA | VL | DIQMTQTTSSLSASLGDRVTISCRASQDISKYLNWYQQ KPDGTVKLLIYHTSRLHSGVPSRFSGSGSGTDYSLTISN LEQEDIATYFCQQGNTLPYTFGGGTKLEIT | 702 |
| CD19-VLB | VL | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIK | 703 |
| CD19-scFv1 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCTVSGVSL PDYGVSWIRQPPGKGLEWIGVIWGSETTYYSSSLKSR VTISKDNSKNQVSLKLSSVTAADTAVYYCAKHYYYGGS YAMDYWGQGTLVTVSS | 704 |
| CD19-scFv2 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCTVSGVSL PDYGVSWIRQPPGKGLEWIGVIWGSETTYYQSSLKSR VTISKDNSKNQVSLKLSSVTAADTAVYYCAKHYYYGGS YAMDYWGQGTLVTVSS | 705 |
| CD19-scFv3 | scFv | QVQLQESGPGLVKPSETLSLTCTVSGVSLPDYGVSWIR QPPGKGLEWIGVIWGSETTYYSSSLKSRVTISKDNSKN QVSLKLSSVTAADTAVYYCAKHYYYGGSYAMDYWGQ GTLVTVSSGGGGSGGGGSGGGGSEIVMTQSPATLSLS PGERATLSCRASQDISKYLNWYQQKPGQAPRLLIYHTS RLHSGIPARFSGSGSGTDYTLTISSLQPEDFAVYFCQQ GNTLPYTFGQGTKLEIK | 706 |
| CD19-scFv4 | scFv | QVQLQESGPGLVKPSETLSLTCTVSGVSLPDYGVSWIR QPPGKGLEWIGVIWGSETTYYQSSLKSRVTISKDNSKN QVSLKLSSVTAADTAVYYCAKHYYYGGSYAMDYWGQ GTLVTVSSGGGGSGGGGSGGGGSEIVMTQSPATLSLS PGERATLSCRASQDISKYLNWYQQKPGQAPRLLIYHTS RLHSGIPARFSGSGSGTDYTLTISSLQPEDFAVYFCQQ GNTLPYTFGQGTKLEIK | 707 |
| CD19-scFv5 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCT VSGVSLPDYGVSWIRQPPGKGLEWIGVIWGSETTYYS SSLKSRVTISKDNSKNQVSLKLSSVTAADTAVYYCAKH YYYGGSYAMDYWGQGTLVTVSS | 708 |
| CD19-scFv6 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCT VSGVSLPDYGVSWIRQPPGKGLEWIGVIWGSETTYYQ SSLKSRVTISKDNSKNQVSLKLSSVTAADTAVYYCAKH YYYGGSYAMDYWGQGTLVTVSS | 709 |

TABLE 16-continued

CD19 Binders

| Name | Domain | Sequence | SEQ ID NO: |
|---|---|---|---|
| CD19-scFv7 | scFv | QVQLQESGPGLVKPSETLSLTCTVSGVSLPDYGVSWIR QPPGKGLEWIGVIWGSETTYYSSSLKSRVTISKDNSKN QVSLKLSSVTAADTAVYYCAKHYYYGGSYAMDYWGQ GTLVTVSSGGGGSGGGGSGGGGSGGGGSEIVMTQS PATLSLSPGERATLSCRASQDISKYLNWYQQKPGQAP RLLIYHTSRLHSGIPARFSGSGSGTDYTLTISSLQPEDF AVYFCQQGNTLPYTFGQGTKLEIK | 710 |
| CD19-scFv8 | scFv | QVQLQESGPGLVKPSETLSLTCTVSGVSLPDYGVSWIR QPPGKGLEWIGVIWGSETTYYQSSLKSRVTISKDNSKN QVSLKLSSVTAADTAVYYCAKHYYYGGSYAMDYWGQ GTLVTVSSGGGGSGGGGSGGGGSGGGGSEIVMTQS PATLSLSPGERATLSCRASQDISKYLNWYQQKPGQAP RLLIYHTSRLHSGIPARFSGSGSGTDYTLTISSLQPEDF AVYFCQQGNTLPYTFGQGTKLEIK | 711 |
| CD19-scFv9 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSGGGGSQVQLQESGPGLVKPSETLSLTCT VSGVSLPDYGVSWIRQPPGKGLEWIGVIWGSETTYYN SSLKSRVTISKDNSKNQVSLKLSSVTAADTAVYYCAKH YYYGGSYAMDYWGQGTLVTVSS | 712 |
| CD19-scFv10 | scFv | QVQLQESGPGLVKPSETLSLTCTVSGVSLPDYGVSWIR QPPGKGLEWIGVIWGSETTYYNSSLKSRVTISKDNSKN QVSLKLSSVTAADTAVYYCAKHYYYGGSYAMDYWGQ GTLVTVSSGGGGSGGGGSGGGGSGGGGSEIVMTQS PATLSLSPGERATLSCRASQDISKYLNWYQQKPGQAP RLLIYHTSRLHSGIPARFSGSGSGTDYTLTISSLQPEDF AVYFCQQGNTLPYTFGQGTKLEIK | 713 |
| CD19-scFv11 | scFv | EIVMTQSPATLSLSPGERATLSCRASQDISKYLNWYQQ KPGQAPRLLIYHTSRLHSGIPARFSGSGSGTDYTLTISS LQPEDFAVYFCQQGNTLPYTFGQGTKLEIKGGGGSGG GGSGGGGSQVQLQESGPGLVKPSETLSLTCTVSGVSL PDYGVSWIRQPPGKGLEWIGVIWGSETTYYNSSLKSR VTISKDNSKNQVSLKLSSVTAADTAVYYCAKHYYYGGS YAMDYWGQGTLVTVSS | 714 |
| CD19-scFv12 | scFv | QVQLQESGPGLVKPSETLSLTCTVSGVSLPDYGVSWIR QPPGKGLEWIGVIWGSETTYYNSSLKSRVTISKDNSKN QVSLKLSSVTAADTAVYYCAKHYYYGGSYAMDYWGQ GTLVTVSSGGGGSGGGGSGGGGSEIVMTQSPATLSLS PGERATLSCRASQDISKYLNWYQQKPGQAPRLLIYHTS RLHSGIPARFSGSGSGTDYTLTISSLQPEDFAVYFCQQ GNTLPYTFGQGTKLEIK | 715 |

In certain aspects, the ABM3 comprises heavy chain CDRs having the amino acid sequences of CD19-H1, CD19-H2A, and CD19-H3 as set forth in Table 16 and light chain CDRs having the amino acid sequences of CD19-L1, CD19-L2, and CD19-L3 as set forth in Table 16. In a specific embodiment, the ABM3 comprises a heavy chain variable region having the amino acid sequences of VHA as set forth in Table 16 and a light chain variable region having the amino acid sequences of VLA as set forth in Table 16.

In other aspects, the ABM3 comprises heavy chain CDRs having the amino acid sequences of CD19-H1, CD19-H2B, and CD19-H3 as set forth in Table 16 and light chain CDRs having the amino acid sequences of CD19-L1, CD19-L2, and CD19-L3 as set forth in Table 16. In a specific embodiment, the ABM3 comprises a heavy chain variable region having the amino acid sequences of VHB as set forth in Table 16 and a light chain variable region having the amino acid sequences of VLB as set forth in Table 16.

In further aspects, the ABM3 comprises heavy chain CDRs having the amino acid sequences of CD19-H1, CD19-H2C, and CD19-H3 as set forth in Table 16 and light chain CDRs having the amino acid sequences of CD19-L1, CD19-L2, and CD19-L3 as set forth in Table 16. In a specific embodiment, ABM3 comprises a heavy chain variable region having the amino acid sequences of VHC as set forth in Table 16 and a light chain variable region having the amino acid sequences of VLB as set forth in Table 16.

In further aspects, the ABM3 comprises heavy chain CDRs having the amino acid sequences of CD19-H1, CD19-H2D, and CD19-H3 as set forth in Table 16 and light chain CDRs having the amino acid sequences of CD19-L1, CD19-L2, and CD19-L3 as set forth in Table 16. In a specific embodiment, the ABM3 comprises a heavy chain variable region having the amino acid sequences of VHD as set forth in Table 16 and a light chain variable region having the amino acid sequences of VLB as set forth in Table 16.

In further aspects, the ABM3 is in the form of an scFV. Exemplary anti-CD19 scFvs comprise the amino acid sequence of any one of CD19-scFv1 through CD19-scFv12 as set forth in Table 16.

In yet further aspects, a TBM comprises an ABM3 that specifically binds to CD19, for example, the anti-CD19 antibody NEG258, the anti-CD19 antibody NEG218, or an antigen-binding domain of either of the foregoing antibodies. The CD2 binding molecule of the disclosure can comprise, for example, CDR, VH, VL, or scFV sequences set forth in Tables 17A-17B (collectively "Table 17"), which list the sequences of exemplary CD19 binding sequences from NEG258 (Table 17A) an NEG218 (Table 17B).

In some embodiments, a CD2 binding molecule comprises CDR-L1, CDR-L2, CDR-L3, CDR-H1, CDR-H2 and CDR-H3 sequences of NEG258 as set forth in Table 17A. The CDR-L1, CDR-L2, CDR-L3, CDR-H1, CDR-H2 and CDR-H3 sequences can be as defined by Kabat, Chothia, or IMGT, or the combined Chothia and Kabat CDR-L1, CDR-L2, CDR-L3, CDR-H1, CDR-H2 and CDR-H3 sequences. The CD2 binding molecule can also comprise a light chain

TABLE 17A

NEG258-Based Binder Sequences

| Chain | Portion | Sequence | SEQ ID NO: |
|---|---|---|---|
| NEG258_VH | CDR-H1 (Combined) | GYTFTTYWIQ | 972 |
|  | CDR-H2 (Combined) | AVYPGDADTRYTQKFQG | 973 |
|  | CDR-H3 (Combined) | DAGLEYYALDY | 974 |
|  | CDR-H1 (Kabat) | TYWIQ | 975 |
|  | CDR-H2 (Kabat) | AVYPGDADTRYTQKFQG | 973 |
|  | CDR-H3 (Kabat) | DAGLEYYALDY | 974 |
|  | CDR-H1 (Chothia) | GYTFTTY | 976 |
|  | CDR-H2 (Chothia) | YPGDAD | 977 |
|  | CDR-H3 (Chothia) | DAGLEYYALDY | 974 |
|  | CDR-H1 (IMGT) | GYTFTTYW | 978 |
|  | CDR-H2 (IMGT) | VYPGDADT | 979 |
|  | CDR-H3 (IMGT) | GRDAGLEYYALDY | 980 |
|  | VH | QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSS | 981 |
| NEG258_VL | CDR-L1 (Combined) | RASQDVGTAVA | 982 |
|  | CDR-L2 (Combined) | WASTRHT | 983 |
|  | CDR-L3 (Combined) | QQYANFPLYT | 984 |
|  | CDR-L1 (Kabat) | RASQDVGTAVA | 982 |
|  | CDR-L2 (Kabat) | WASTRHT | 983 |
|  | CDR-L3 (Kabat) | QQYANFPLYT | 984 |
|  | CDR-L1 (Chothia) | SQDVGTA | 985 |
|  | CDR-L2 (Chothia) | WAS | 986 |
|  | CDR-L3 (Chothia) | YANFPLY | 987 |
|  | CDR-L1 (IMGT) | QDVGTA | 988 |
|  | CDR-L2 (IMGT) | WAS | 986 |
|  | CDR-L3 (IMGT) | QQYANFPLYT | 984 |
|  | VL | EIVMTQSPATLSVSPGERATLSCRASQDVGTAVAWYQQKPGQAPRLLIYWASTRHTGIPARFSGSGSGTEFTLTISSLQSEDFAVYFCQQYANFPLYTFGQGTKLEIK | 989 | variable sequence and/or heavy chain variable sequence of the anti-CD19 antibody NEG258 as set forth in Table 17A.

The sequences set forth in Table 17B are based on the CD19 antibody NEG218.

TABLE 17B

NEG218-Based Sequences

| Chain | Portion | Sequence | SEQ ID NO: |
|---|---|---|---|
| NEG218_VH | CDR-H1 (Combined) | GYSFTNYWMN | 990 |
| | CDR-H2 (Combined) | MIHPSDSEIRLNQKFQG | 991 |
| | CDR-H3 (Combined) | WYYLSSPMDY | 992 |
| | CDR-H1 (Kabat) | NYWMN | 993 |
| | CDR-H2 (Kabat) | MIHPSDSEIRLNQKFQG | 991 |
| | CDR-H3 (Kabat) | WYYLSSPMDY | 992 |
| | CDR-H1 (Chothia) | GYSFTNY | 994 |
| | CDR-H2 (Chothia) | HPSDSE | 995 |
| | CDR-H3 (Chothia) | WYYLSSPMDY | 992 |
| | CDR-H1 (IMGT) | GYSFTNYW | 996 |
| | CDR-H2 (IMGT) | IHPSDSEI | 997 |
| | CDR-H3 (IMGT) | SRWYYLSSPMDY | 998 |
| | VH | EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSS | 999 |
| NEG218_VL | CDR-L1 (Combined) | RASQDVGTAVA | 982 |
| | CDR-L2 (Combined) | WASTRHT | 983 |
| | CDR-L3 (Combined) | QQYSSYPYT | 1000 |
| | CDR-L1 (Kabat) | RASQDVGTAVA | 982 |
| | CDR-L2 (Kabat) | WASTRHT | 983 |
| | CDR-L3 (Kabat) | QQYSSYPYT | 1000 |
| | CDR-L1 (Chothia) | SQDVGTA | 985 |
| | CDR-L2 (Chothia) | WAS | 986 |
| | CDR-L3 (Chothia) | YSSYPY | 1001 |
| | CDR-L1 (IMGT) | QDVGTA | 988 |
| | CDR-L2 (IMGT) | WAS | 986 |
| | CDR-L3 (IMGT) | QQYSSYPYT | 1000 |
| | VL | EIVMTQSPATLSVSPGERATLSCRASQDVGTAVAWYQQKPGQAPRLLIYWASTRHTGIPARFSGSGSGTEFTLTISSLQSEDFAVYFCQQYSSYPYTFGQGTKLEIK | 1002 |

In some embodiments, a CD2 binding molecule comprises CDR-L1, CDR-L2, CDR-L3, CDR-H1, CDR-H2 and CDR-H3 sequences of NEG218 as set forth in Table 17A. The CDR-L1, CDR-L2, CDR-L3, CDR-H1, CDR-H2 and CDR-H3 sequences can be as defined by Kabat, Chothia, or IMGT, or the combined Chothia and Kabat CDR-L1, CDR-L2, CDR-L3, CDR-H1, CDR-H2 and CDR-H3 sequences. The CD2 binding molecule can also comprise a light chain variable sequence and/or heavy chain variable sequence of the anti-CD19 antibody NEG218 as set forth in Table 17B.

7.11. Nucleic Acids and Host Cells

In another aspect, the disclosure provides nucleic acids (i.e., polynucleotides) encoding the CD2 binding molecules of the disclosure. In some embodiments, the CD2 binding molecules are encoded by a single nucleic acid. In other embodiments, the CD2 binding molecules are encoded by a plurality of (e.g., two, three, four or more) nucleic acids.

A single nucleic acid can encode a CD2 binding molecule that comprises a single polypeptide chain, a CD2 binding molecule that comprises two or more polypeptide chains, or a portion of a CD2 binding molecule that comprises more than two polypeptide chains (for example, a single nucleic acid can encode two polypeptide chains of a CD2 binding molecule comprising three, four or more polypeptide chains, or three polypeptide chains of a CD2 binding molecule comprising four or more polypeptide chains). For separate control of expression, the open reading frames encoding two or more polypeptide chains can be under the control of separate transcriptional regulatory elements (e.g., promoters and/or enhancers). The open reading frames encoding two or more polypeptides can also be controlled by the same transcriptional regulatory elements, and separated by internal ribosome entry site (IRES) sequences allowing for translation into separate polypeptides.

In some embodiments, a CD2 binding molecule comprising two or more polypeptide chains is encoded by two or more nucleic acids. The number of nucleic acids encoding a CD2 binding molecule can be equal to or less than the number of polypeptide chains in the CD2 binding molecule (for example, when more than one polypeptide chains are encoded by a single nucleic acid).

The nucleic acids can be DNA or RNA (e.g., mRNA).

In another aspect, the disclosure provides host cells and vectors containing the nucleic acids of the disclosure. The nucleic acids can be present in a single vector or separate vectors present in the same host cell or separate host cell, as described in more detail herein below.

7.11.1. Vectors

The disclosure provides vectors comprising nucleotide sequences encoding a CD2 binding molecule or a CD2 binding molecule component described herein. In one embodiment, the vectors comprise nucleotides encoding an immunoglobulin-based ABM described herein. In one embodiment, the vectors comprise nucleotides encoding an Fc domain described herein. In one embodiment, the vectors comprise nucleotides encoding a recombinant non-immunoglobulin based ABM described herein. A vector can encode one or more ABMs, one or more Fc domains, one or more non-immunoglobulin based ABM, or any combination thereof (e.g., when multiple components or sub-components are encoded as a single polypeptide chain). In one embodiment, the vectors comprise the nucleotide sequences described herein. The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes can be selected by introducing one or more markers which allow for the selection of transfected host cells. The marker can provide, for example, prototropy to an auxotrophic host, biocide resistance (e.g., antibiotics), or resistance to heavy metals such as copper, or the like. The selectable marker gene can be either directly linked to the DNA sequences to be expressed, or introduced into the same cell by cotransformation. Additional elements may also be needed for optimal synthesis of mRNA. These elements can include splice signals, as well as transcriptional promoters, enhancers, and termination signals.

Once the expression vector or DNA sequence containing the constructs has been prepared for expression, the expression vectors can be transfected or introduced into an appropriate host cell. Various techniques can be employed to achieve this, such as, for example, protoplast fusion, calcium phosphate precipitation, electroporation, retroviral transduction, viral transfection, gene gun, lipid based transfection or other conventional techniques. Methods and conditions for culturing the resulting transfected cells and for recovering the expressed polypeptides are known to those skilled in the art, and can be varied or optimized depending upon the specific expression vector and mammalian host cell employed, based upon the present description.

7.11.2. Cells

The disclosure also provides host cells comprising a nucleic acid of the disclosure.

In one embodiment, the host cells are genetically engineered to comprise one or more nucleic acids described herein.

In one embodiment, the host cells are genetically engineered by using an expression cassette. The phrase "expression cassette," refers to nucleotide sequences, which are capable of affecting expression of a gene in hosts compatible with such sequences. Such cassettes can include a promoter, an open reading frame with or without introns, and a termination signal. Additional factors necessary or helpful in effecting expression can also be used, such as, for example, an inducible promoter.

The disclosure also provides host cells comprising the vectors described herein.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

7.12. CD2 Binding Molecules with Extended In Vivo Half-Life

The CD2 binding molecules of the disclosure can be modified to have an extended half-life in vivo.

A variety of strategies can be used to extend the half life of CD2 binding molecules of the disclosure. For example, by chemical linkage to polyethyleneglycol (PEG), reCODE PEG, antibody scaffold, polysialic acid (PSA), hydroxyethyl starch (HES), albumin-binding ligands, and carbohydrate shields; by genetic fusion to proteins binding to serum proteins, such as albumin, IgG, FcRn, and transferring; by coupling (genetically or chemically) to other binding moieties that bind to serum proteins, such as nanobodies, Fabs, DARPins, avimers, affibodies, and anticalins; by genetic fusion to rPEG, albumin, domain of albumin, albumin-binding proteins, and Fc; or by incorporation into nanocarriers, slow release formulations, or medical devices.

To prolong the serum circulation of CD2 binding molecules in vivo, inert polymer molecules such as high molecular weight PEG can be attached to the CD2 binding molecules with or without a multifunctional linker either through site-specific conjugation of the PEG to the N- or C-terminus of a polypeptide comprising the CD2 binding molecule or via epsilon-amino groups present on lysine residues. To pegylate a CD2 binding molecule, the molecule can be reacted with polyethylene glycol (PEG), such as a reactive ester or aldehyde derivative of PEG, under conditions in which one or more PEG groups become attached to the CD2 binding molecules. The pegylation can be carried out by an acylation reaction or an alkylation reaction with a reactive PEG molecule (or an analogous reactive water-soluble polymer). As used herein, the term "polyethylene glycol" is intended to encompass any one of the forms of PEG that have been used to derivatize other proteins, such as mono (C1-C10)alkoxy- or aryloxy-polyethylene glycol or polyethylene glycol-maleimide. In one embodiment, the CD2 binding molecule to be pegylated is an aglycosylated antibody. Linear or branched polymer derivatization that results in minimal loss of biological activity will be used. The degree of conjugation can be closely monitored by SDS-PAGE and mass spectrometry to ensure proper conjugation of PEG molecules to the antibodies. Unreacted PEG can be separated from antibody-PEG conjugates by size-exclusion or by ion-exchange chromatography. PEG-derivatized antibodies can be tested for binding activity as well as for in vivo efficacy using methods well-known to those of skill in the art, for example, by immunoassays described herein. Methods for pegylating proteins are known and can be applied to CD2 binding molecules of the disclosure. See for example, EP 0154316 by Nishimura et al. and EP 0401384 by Ishikawa et al.

Other modified pegylation technologies include reconstituting chemically orthogonal directed engineering technology (ReCODE PEG), which incorporates chemically specified side chains into biosynthetic proteins via a reconstituted system that includes tRNA synthetase and tRNA. This technology enables incorporation of more than 30 new amino acids into biosynthetic proteins in E. coli, yeast, and mammalian cells. The tRNA incorporates a normative amino acid any place an amber codon is positioned, converting the amber from a stop codon to one that signals incorporation of the chemically specified amino acid.

Recombinant pegylation technology (rPEG) can also be used for serum half life extension. This technology involves genetically fusing a 300-600 amino acid unstructured protein tail to an existing pharmaceutical protein. Because the apparent molecular weight of such an unstructured protein chain is about 15-fold larger than its actual molecular weight, the serum half life of the protein is greatly increased. In contrast to traditional PEGylation, which requires chemical conjugation and repurification, the manufacturing process is greatly simplified and the product is homogeneous.

Polysialytion is another technology, which uses the natural polymer polysialic acid (PSA) to prolong the active life and improve the stability of therapeutic peptides and proteins. PSA is a polymer of sialic acid (a sugar). When used for protein and therapeutic peptide drug delivery, polysialic acid provides a protective microenvironment on conjugation. This increases the active life of the therapeutic protein in the circulation and prevents it from being recognized by the immune system. The PSA polymer is naturally found in the human body. It was adopted by certain bacteria which evolved over millions of years to coat their walls with it. These naturally polysialylated bacteria were then able, by virtue of molecular mimicry, to foil the body's defense system. PSA, nature's ultimate stealth technology, can be easily produced from such bacteria in large quantities and with predetermined physical characteristics. Bacterial PSA is completely non-immunogenic, even when coupled to proteins, as it is chemically identical to PSA in the human body.

Another technology include the use of hydroxyethyl starch ("HES") derivatives linked to CD2 binding molecules. HES is a modified natural polymer derived from waxy maize starch and can be metabolized by the body's enzymes. HES solutions are usually administered to substitute deficient blood volume and to improve the rheological properties of the blood. Hesylation of a CD2 binding molecule enables the prolongation of the circulation half-life by increasing the stability of the molecule, as well as by reducing renal clearance, resulting in an increased biological activity. By varying different parameters, such as the molecular weight of HES, a wide range of HES CD2 binding molecule conjugates can be customized.

CD2 binding molecules having an increased half-life in vivo can also be generated introducing one or more amino acid modifications (i.e., substitutions, insertions or deletions) into an IgG constant domain, or FcRn binding fragment thereof (e.g., an Fc or hinge Fc domain fragment). See, e.g., International Publication No. WO 98/23289; International Publication No. WO 97/34631; and U.S. Pat. No. 6,277,375.

Furthermore, the CD2 binding molecules can be conjugated to albumin, a domain of albumin, an albumin-binding protein, or an albumin-binding antibody or antibody fragments thereof, in order to make the molecules more stable in vivo or have a longer half life in vivo. The techniques are well-known, see, e.g., International Publication Nos. WO 93/15199, WO 93/15200, and WO 01/77137; and European Patent No. EP 413,622.

The CD2 binding molecules of the present disclosure can also be fused to one or more human serum albumin (HSA) polypeptides, or a portion thereof. The use of albumin as a component of an albumin fusion protein as a carrier for various proteins has been suggested in WO 93/15199, WO 93/15200, and EP 413 622. The use of N-terminal fragments of HSA for fusions to polypeptides has also been proposed (EP 399 666). Accordingly, by genetically or chemically fusing or conjugating the molecules to albumin, can stabilize or extend the shelf-life, and/or to retain the molecule's activity for extended periods of time in solution, in vitro and/or in vivo. Additional methods pertaining to HSA fusions can be found, for example, in WO 2001077137 and WO 200306007. In an embodiment, the expression of the fusion protein is performed in mammalian cell lines, for example, CHO cell lines.

The CD2 binding molecules of the present disclosure can also be fused to an antibody or antibody fragment thereof that binds to albumin, e.g., human serum albumin (HSA). The albumin-binding antibody or antibody fragment thereof can be a Fab, a scFv, a Fv, an scFab, a (Fab')2, a single domain antibody, a camelid VHH domain, a VH or VL domain, or a full-length monoclonal antibody (mAb).

The CD2 binding molecules of the present disclosure can also be fused to a fatty acid to extend their half-life. Fatty acids suitable for linking to a biomolecule have been described in the art, e.g., WO2015/200078, WO2015/191781, US2013/0040884. Suitable half-life extending fatty acids include those defined as a C6-70alkyl, a C6-70alkenyl or a C6-70alkynyl chain, each of which is substituted with at least one carboxylic acid (for example 1, 2, 3 or 4 CO2H) and optionally further substituted with hydroxyl group. For example, the CD2 binding molecules described herein can be linked to a fatty acid having any of the following Formulae A1, A2 or A3:

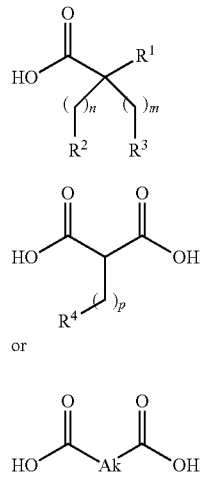

A1

A2

A3

$R^1$ is $CO_2H$ or H;
$R^2$, $R^3$ and $R^4$ are independently of each other H, OH, $CO_2H$, —CH=$CH_2$ or —C≡CH;
Ak is a branched $C_6$-$C_{30}$ alkylene;
n, m and p are independently of each other an integer between 6 and 30; or an amide, ester or pharmaceutically acceptable salt thereof.

In some embodiments, the fatty acid is of Formula A1, e.g., a fatty acid of Formula A1 where n and m are independently 8 to 20, e.g., 10 to 16. In another embodiment, the fatty acid moiety is of Formula A1 and where at least one of $R^2$ and $R^3$ is $CO_2H$.

In some embodiments, the fatty acid is selected from the following Formulae:

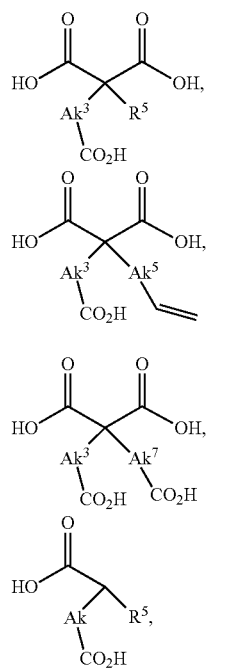

where $Ak^3$, $Ak^4$, $Ak^5$, $Ak^6$ and $Ak^7$ are independently a $(C_{8-20})$alkylene, $R^5$ and $R^6$ are independently $(C_{8-20})$alkyl.

In some embodiments, the fatty acid is selected from the following Formulae:

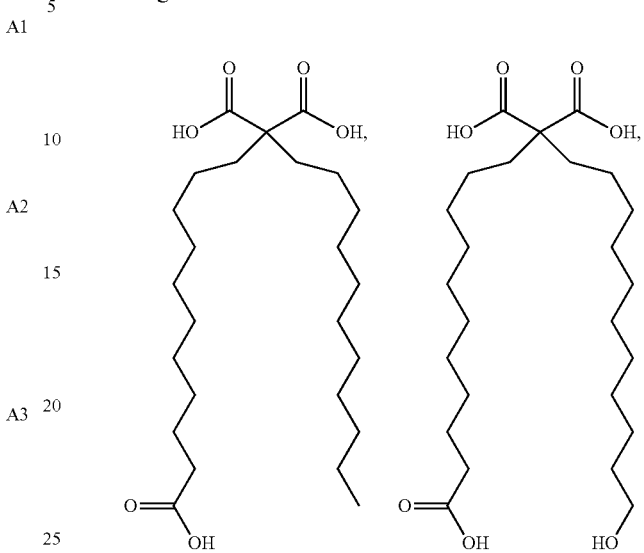

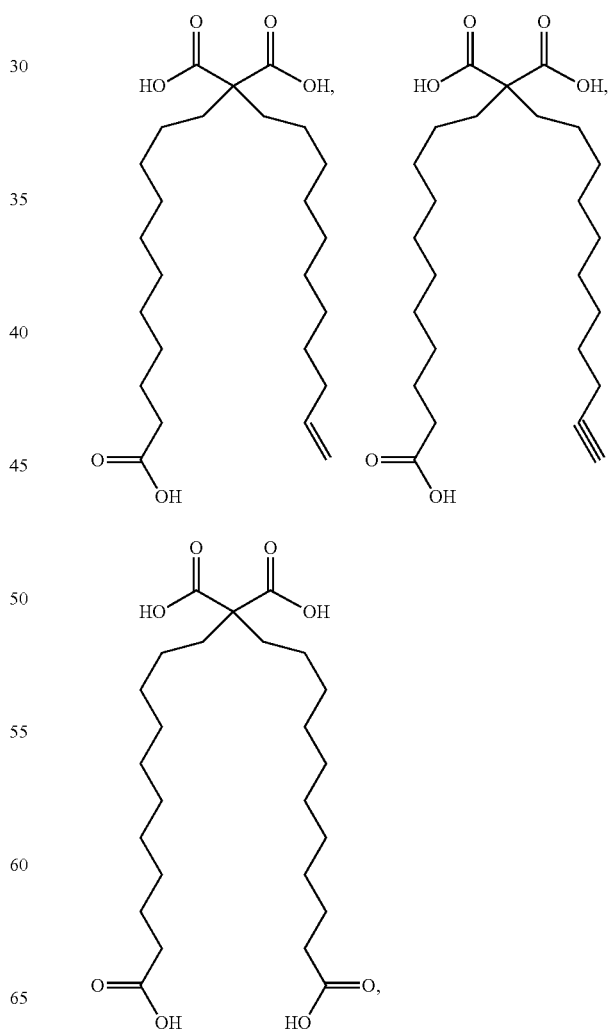

-continued

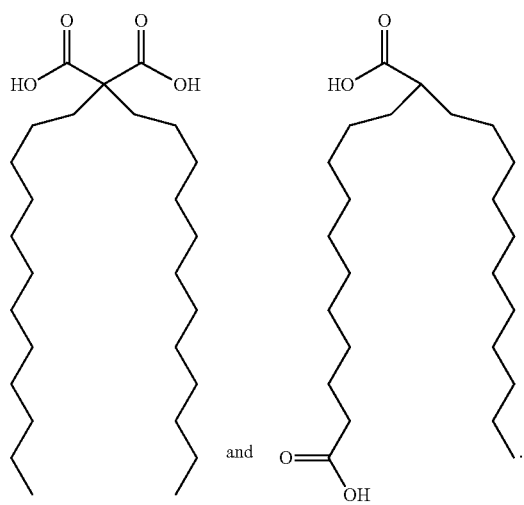 [SMILES: CCCCCCCCCCCCC(CCCCCCCCCCCC)(C(=O)O)C(=O)O ; CCCCCCCCCCCC(CCCCCCCCCCC(=O)O)C(=O)O]

In some embodiments, the fatty acid is selected from the following Formulae:

-continued

In some embodiments, the fatty acid is of Formula A2 or A3. In a particular embodiment, the conjugate comprises a fatty acid moiety of Formula A2 where p is 8 to 20, or a fatty acid moiety of Formula A3 where Ak is $C_{8-20}$alkylene.

7.13. Antibody-Drug Conjugates

The CD2 binding molecules of the disclosure can be conjugated, e.g., via a linker, to a drug moiety. Such conjugates are referred to herein as antibody-drug conjugates (or "ADCs") for convenience, notwithstanding the fact that one or more of the ABMs might be based on non-immunoglobulin scaffolds, e.g., a MBM comprising one or more non-immunoglobulin based ABMs, such as a TCR ABM comprising Affilin-144160).

In certain aspects, the drug moiety exerts a cytotoxic or cytostatic activity. In one embodiment, the drug moiety is chosen from a maytansinoid, a kinesin-like protein KIF11 inhibitor, a V-ATPase (vacuolar-type H+-ATPase) inhibitor, a pro-apoptotic agent, a Bcl2 (B-cell lymphoma 2) inhibitor, an MCL1 (myeloid cell leukemia 1) inhibitor, a HSP90 (heat shock protein 90) inhibitor, an IAP (inhibitor of apoptosis) inhibitor, an mTOR (mechanistic target of rapamycin) inhibitor, a microtubule stabilizer, a microtubule destabilizer, an auristatin, a dolastatin, a MetAP (methionine aminopeptidase), a CRM1 (chromosomal maintenance 1) inhibitor, a DPPIV (dipeptidyl peptidase IV) inhibitor, a proteasome inhibitor, an inhibitor of a phosphoryl transfer reaction in mitochondria, a protein synthesis inhibitor, a kinase inhibitor, a CDK2 (cyclin-dependent kinase 2) inhibitor, a CDK9 (cyclin-dependent kinase 9) inhibitor, a kinesin inhibitor, an HDAC (histone deacetylase) inhibitor, a DNA damaging agent, a DNA alkylating agent, a DNA intercalator, a DNA minor groove binder, a RNA polymerase inhibitor, a topoisomerase inhibitor, or a DHFR (dihydrofolate reductase) inhibitor. In some embodiments, the drug moiety is a radioactive metal ion, such as alpha-emitters such as 213Bi or macrocyclic chelators useful for conjugating radiometal ions, including but not limited to, 131In, 131LU, 131Y, 131Ho, 131Sm, to polypeptides. In one embodiment, the macrocyclic chelator is 1,4,7,10-tetraazacyclododecane-N,N',N'',N'''-tetraacetic acid (DOTA).

In one embodiment, the linker is chosen from a cleavable linker, a non-cleavable linker, a hydrophilic linker, a procharged linker, or a dicarboxylic acid based linker.

In some embodiments, the ADCs are compounds according to structural formula (I):

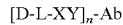
[D-L-XY]$_n$-Ab or salts thereof, where each "D" represents, independently of the others, a cytotoxic and/or cytostatic agent ("drug"); each "L" represents, independently of the others, a linker; "Ab" represents a CD2 binding molecule described herein; each "XY" represents a linkage formed between a functional group $R^x$ on the linker and a "complementary" functional group $R^y$ on the antibody, and n represents the number of drugs linked to, or drug-to-antibody ratio (DAR), of the ADC.

Some embodiments of the various antibodies (Ab) that can comprise the ADCs include the various embodiments of CD2 binding molecules described above.

In some embodiments of the ADCs and/or salts of structural formula (I), each D is the same and/or each L is the same.

Some embodiments of cytotoxic and/or cytostatic agents (D) and linkers (L) that can comprise the ADCs of the disclosure, as well as the number of cytotoxic and/or cytostatic agents linked to the ADCs, are described in more detail below.

7.13.1. Cytotoxic and/or Cytostatic Agents

The cytotoxic and/or cytostatic agents can be any agents known to inhibit the growth and/or replication of and/or kill cells, and in particular cancer and/or tumor cells. Numerous agents having cytotoxic and/or cytostatic properties are known in the literature. Non-limiting examples of classes of cytotoxic and/or cytostatic agents include, by way of example and not limitation, radionuclides, alkylating agents, topoisomerase I inhibitors, topoisomerase II inhibitors, DNA intercalating agents (e.g., groove binding agents such as minor groove binders), RNA/DNA antimetabolites, cell cycle modulators, kinase inhibitors, protein synthesis inhibitors, histone deacetylase inhibitors, mitochondria inhibitors, and antimitotic agents.

Specific non-limiting examples of agents within certain of these various classes are provided below.

Alkylating Agents: asaley ((L-Leucine, N—[N-acetyl-4-[bis-(2-chloroethyl)amino]-DL-phenylalanyl]-, ethylester; NSC 167780; CAS Registry No. 3577897)); AZQ ((1,4-cyclohexadiene-1,4-dicarbamic acid, 2,5-bis(1-aziridinyl)-3,6-dioxo-, diethyl ester; NSC 182986; CAS Registry No. 57998682)); BCNU ((N,N'-Bis(2-chloroethyl)-N-nitrosourea; NSC 409962; CAS Registry No. 154938)); busulfan (1,4-butanediol dimethanesulfonate; NSC 750; CAS Registry No. 55981); (carboxyphthalato)platinum (NSC 27164; CAS Registry No. 65296813); CBDCA ((cis-(1,1-cyclobutanedicarboxylato)diammineplatinum(II)); NSC 241240; CAS Registry No. 41575944)); CCNU ((N-(2-chloroethyl)-N'-cyclohexyl-N-nitrosourea; NSC 79037; CAS Registry No. 13010474)); CHIP (iproplatin; NSC 256927); chlorambucil (NSC 3088; CAS Registry No. 305033); chlorozotocin ((2-[[[(2-chloroethyl) nitrosoamino]carbonyl]amino]-2-deoxy-D-glucopyranose; NSC 178248; CAS Registry No. 54749905)); cis-platinum (cisplatin; NSC 119875; CAS Registry No. 15663271); clomesone (NSC 338947; CAS Registry No. 88343720); cyanomorpholino-doxorubicin (NCS 357704; CAS Registry No. 88254073); cyclodisone (NSC 348948; CAS Registry No. 99591738); dianhydrogalactitol (5,6-diepoxydulcitol; NSC 132313; CAS Registry No. 23261203); fluorodopan ((5-[(2-chloroethyl)-(2-fluoroethyl)amino]-6-methyl-uracil; NSC 73754; CAS Registry No. 834913); hepsulfam (NSC 329680; CAS Registry No. 96892578); hycanthone (NSC 142982; CAS Registry No. 23255938); melphalan (NSC 8806; CAS Registry No. 3223072); methyl CCNU ((1-(2-chloroethyl)-3-(trans-4-methylcyclohexane)-1-nitrosourea; NSC 95441; 13909096); mitomycin C (NSC 26980; CAS Registry No. 50077); mitozolamide (NSC 353451; CAS Registry No. 85622953); nitrogen mustard ((bis(2-chloroethyl)methylamine hydrochloride; NSC 762; CAS Registry No. 55867); PCNU ((1-(2-chloroethyl)-3-(2,6-dioxo-3-piperidyl)-1-nitrosourea; NSC 95466; CAS Registry No. 13909029)); piperazine alkylator ((1-(2-chloroethyl)-4-(3-chloropropyl)-piperazine dihydrochloride; NSC 344007)); piperazinedione (NSC 135758; CAS Registry No. 41109802); pipobroman ((N,N-bis(3-bromopropionyl) piperazine; NSC 25154; CAS Registry No. 54911)); porfiromycin (N-methylmitomycin C; NSC 56410; CAS Registry No. 801525); spirohydantoin mustard (NSC 172112; CAS Registry No. 56605164); teroxirone (triglycidylisocyanurate; NSC 296934; CAS Registry No. 2451629); tetraplatin (NSC 363812; CAS Registry No. 62816982); thio-tepa (N,N',N''-tri-1,2-ethanediylthio phosphoramide; NSC 6396; CAS Registry No. 52244); triethylenemelamine (NSC 9706; CAS Registry No. 51183); uracil nitrogen mustard (desmethyldopan; NSC 34462; CAS Registry No. 66751); Yoshi-864 ((bis(3-mesyloxy propyl)amine hydrochloride; NSC 102627; CAS Registry No. 3458228).

Topoisomerase I Inhibitors: camptothecin (NSC 94600; CAS Registry No. 7689-03-4); various camptothecin derivatives and analogs (for example, NSC 100880, NSC 603071, NSC 107124, NSC 643833, NSC 629971, NSC 295500, NSC 249910, NSC 606985, NSC 74028, NSC 176323, NSC 295501, NSC 606172, NSC 606173, NSC 610458, NSC 618939, NSC 610457, NSC 610459, NSC 606499, NSC 610456, NSC 364830, and NSC 606497); morpholinisoxorubicin (NSC 354646; CAS Registry No. 89196043); SN-38 (NSC 673596; CAS Registry No. 86639-52-3).

Topoisomerase II Inhibitors: doxorubicin (NSC 123127; CAS Registry No. 25316409); amonafide (benzisoquinolinedione; NSC 308847; CAS Registry No. 69408817); m-AMSA ((4'-(9-acridinylamino)-3'-methoxymethanesulfonanilide; NSC 249992; CAS Registry No. 51264143)); anthrapyrazole derivative ((NSC 355644); etoposide (VP-16; NSC 141540; CAS Registry No. 33419420); pyrazoloacridine ((pyrazolo[3,4,5-kl]acridine-2(6H)-propanamine, 9-methoxy-N, N-dimethyl-5-nitro-, monomethanesulfonate; NSC 366140; CAS Registry No. 99009219); bisantrene hydrochloride (NSC 337766; CAS Registry No. 71439684); daunorubicin (NSC 821151; CAS Registry No. 23541506); deoxydoxorubicin (NSC 267469; CAS Registry No. 63950061); mitoxantrone (NSC 301739; CAS Registry No. 70476823); menogaril (NSC 269148; CAS Registry No. 71628961); N,N-dibenzyl daunomycin (NSC 268242; CAS Registry No. 70878512); oxanthrazole (NSC 349174; CAS Registry No. 105118125); rubidazone (NSC 164011; CAS Registry No. 36508711); teniposide (VM-26; NSC 122819; CAS Registry No. 29767202).

DNA Intercalating Agents: anthramycin (CAS Registry No. 4803274); chicamycin A (CAS Registry No. 89675376); tomaymycin (CAS Registry No. 35050556); DC-81 (CAS Registry No. 81307246); sibiromycin (CAS Registry No. 12684332); pyrrolobenzodiazepine derivative (CAS Registry No. 945490095); SGD-1882 ((S)-2-(4-ami nophenyl)-7-methoxy-8-(3-4(S)-7-methoxy-2-(4-methoxyphenyl)-5-oxo-5,11a-dihydro-1H-benzo[e]pyrrolo[1,2-a][1,4]diazepin-8-yl)oxy)propox-y)-1H-benzo[e]pyrrolo[1,2-a][1,4]diazepin-5(11aH)-one); SG2000 (SJG-136; (11aS,11a'S)-8,8'-(propane-1,3-diylbis(oxy))bis(7-methoxy-2-methylene-2,3-dihydro-1H-benzo[e]pyrrolo[1,2-a][1,4]diazepin-5(11aH)-one); NSC 694501; CAS Registry No. 232931576).

RNA/DNA Antimetabolites: L-alanosine (NSC 153353; CAS Registry No. 59163416); 5-azacytidine (NSC 102816; CAS Registry No. 320672); 5-fluorouracil (NSC 19893; CAS Registry No. 51218); acivicin (NSC 163501; CAS Registry No. 42228922); aminopterin derivative N-[2-chloro-5-[[(2,4-diamino-5-methyl-6-quinazolinyl)methyl]amino]benzoyl-]L-aspartic acid (NSC 132483); aminopterin derivative N-[4-[[(2,4-diamino-5-ethyl-6-quinazolinyl)methyl]amino]benzoyl]L-asparti-c acid (NSC 184692); aminopterin derivative N-[2-chloro-4-[[(2,4-diamino-6-pteridinyl)methyl]amino]benzoyl]L-aspartic acid monohydrate (NSC 134033); an antifo ((N$^\alpha$-(4-amino-4-deoxypteroyl)-N$^7$-hemiphthaloyl-L-ornithin-e; NSC 623017)); Baker's soluble antifol (NSC 139105; CAS Registry No. 41191042); dichlorallyl lawsone ((2-(3,3-dichloroallyl)-3-hydroxy-1,4-naphthoquinone; NSC 126771; CAS Registry No. 36417160); brequinar (NSC 368390; CAS Registry No. 96201886); ftorafur ((pro-drug; 5-fluoro-1-(tetrahydro-2-furyl)-uracil; NSC 148958; CAS Registry No. 37076689); 5,6-dihydro-5-azacytidine (NSC 264880; CAS Registry No. 62402317); methotrexate (NSC 740; CAS Registry No. 59052); methotrexate derivative (N-[[4-[[(2,4-diamino-6-pteridinyl)methyl]methylamino]-1-naphthalenyl]car-bonyl] L-glutamic acid; NSC 174121); PALA ((N-(phosphonoacetyl)-L-aspartate; NSC 224131; CAS Registry No. 603425565); pyrazofurin (NSC 143095; CAS Registry No. 30868305); trimetrexate (NSC 352122; CAS Registry No. 82952645).

DNA Antimetabolites: 3-HP (NSC 95678; CAS Registry No. 3814797); 2'-deoxy-5-fluorouridine (NSC 27640; CAS Registry No. 50919); 5-HP (NSC 107392; CAS Registry No. 19494894); α-TGDR (α-2'-deoxy-6-thioguanosine; NSC 71851 CAS Registry No. 2133815); aphidicolin glycinate (NSC 303812; CAS Registry No. 92802822); ara C (cytosine arabinoside; NSC 63878; CAS Registry No. 69749); 5-aza-2'-deoxycytidine (NSC 127716; CAS Registry No. 2353335); β-TGDR (β-2'-deoxy-6-thioguanosine; NSC 71261; CAS Registry No. 789617); cyclocytidine (NSC 145668; CAS Registry No. 10212256); guanazole (NSC 1895; CAS Registry No. 1455772); hydroxyurea (NSC 32065; CAS Registry No. 127071); inosine glycodialdehyde (NSC 118994; CAS Registry No. 23590990); macbecin II (NSC 330500; CAS Registry No. 73341738); pyrazoloimidazole (NSC 51143; CAS Registry No. 6714290); thioguanine (NSC 752; CAS Registry No. 154427); thiopurine (NSC 755; CAS Registry No. 50442).

Cell Cycle Modulators: silibinin (CAS Registry No. 22888-70-6); epigallocatechin gallate (EGCG; CAS Registry No. 989515); procyanidin derivatives (e.g., procyanidin A1 [CAS Registry No. 103883030], procyanidin B1 [CAS Registry No. 20315257], procyanidin B4 [CAS Registry No. 29106512], arecatannin B1 [CAS Registry No. 79763283]); isoflavones (e.g., genistein [4',5,7-trihydroxyisoflavone; CAS Registry No. 446720], daidzein [4',7-dihydroxyisoflavone, CAS Registry No. 486668]; indole-3-carbinol (CAS Registry No. 700061); quercetin (NSC 9219; CAS Registry No. 117395); estramustine (NSC 89201; CAS Registry No. 2998574); nocodazole (CAS Registry No. 31430189); podophyllotoxin (CAS Registry No. 518285); vinorelbine tartrate (NSC 608210; CAS Registry No. 125317397); cryptophycin (NSC 667642; CAS Registry No. 124689652).

Kinase Inhibitors: afatinib (CAS Registry No. 850140726); axitinib (CAS Registry No. 319460850); ARRY-438162 (binimetinib) (CAS Registry No. 606143899); bosutinib (CAS Registry No. 380843754); cabozantinib (CAS Registry No. 1140909483); ceritinib (CAS Registry No. 1032900256); crizotinib (CAS Registry No. 877399525); dabrafenib (CAS Registry No. 1195765457); dasatinib (NSC 732517; CAS Registry No. 302962498); erlotinib (NSC 718781; CAS Registry No. 183319699); everolimus (NSC 733504; CAS Registry No. 159351696); fostamatinib (NSC 745942; CAS Registry No. 901119355); gefitinib (NSC 715055; CAS Registry No. 184475352); ibrutinib (CAS Registry No. 936563961); imatinib (NSC 716051; CAS Registry No. 220127571); lapatinib (CAS Registry No. 388082788); lenvatinib (CAS Registry No. 857890392); mubritinib (CAS 366017096); nilotinib (CAS Registry No. 923288953); nintedanib (CAS Registry No. 656247175); palbociclib (CAS Registry No. 571190302); pazopanib (NSC 737754; CAS Registry No. 635702646); pegaptanib (CAS Registry No. 222716861); ponatinib (CAS Registry No. 1114544318); rapamycin (NSC 226080; CAS Registry No. 53123889); regorafenib (CAS Registry No. 755037037); AP 23573 (ridaforolimus) (CAS Registry No. 572924540); INCB018424 (ruxolitinib) (CAS Registry No. 1092939177); ARRY-142886 (selumetinib) (NSC 741078; CAS Registry No. 606143-52-6); sirolimus (NSC 226080; CAS Registry No. 53123889); sorafenib (NSC 724772; CAS Registry No. 475207591); sunitinib (NSC 736511; CAS Registry No. 341031547); tofacitinib (CAS Registry No. 477600752); temsirolimus (NSC 683864; CAS Registry No. 163635043); trametinib (CAS Registry No. 871700173); vandetanib (CAS Registry No. 443913733); vemurafenib (CAS Registry No. 918504651); SU6656 (CAS Registry No. 330161870); CEP-701 (lesaurtinib) (CAS Registry No. 111358884); XL019 (CAS Registry No. 945755566); PD-325901 (CAS Registry No. 391210109); PD-98059 (CAS Registry No. 167869218); ATP-competitive TORC1/TORC2 inhibitors including PI-103 (CAS Registry No. 371935749), PP242 (CAS Registry No. 1092351671), PP30 (CAS Registry No. 1092788094), Torin 1 (CAS Registry No. 1222998368), LY294002 (CAS Registry No. 154447366), XL-147 (CAS Registry No. 934526893), CAL-120 (CAS Registry No. 870281348), ETP-45658 (CAS Registry No. 1198357797), PX 866 (CAS Registry No. 502632668), GDC-0941 (CAS Registry No. 957054307), BGT226 (CAS Registry No. 1245537681), BEZ235 (CAS Registry No. 915019657), XL-765 (CAS Registry No. 934493762).

Protein Synthesis Inhibitors: acriflavine (CAS Registry No. 65589700); amikacin (NSC 177001; CAS Registry No. 39831555); arbekacin (CAS Registry No. 51025855); astromicin (CAS Registry No. 55779061); azithromycin (NSC 643732; CAS Registry No. 83905015); bekanamycin (CAS Registry No. 4696768); chlortetracycline (NSC 13252; CAS Registry No. 64722); clarithromycin (NSC 643733; CAS Registry No. 81103119); clindamycin (CAS Registry No. 18323449); clomocycline (CAS Registry No. 1181540); cycloheximide (CAS Registry No. 66819); dactinomycin (NSC 3053; CAS Registry No. 50760); dalfopristin (CAS Registry No. 112362502); demeclocycline (CAS Registry No. 127333); dibekacin (CAS Registry No. 34493986); dihydrostreptomycin (CAS Registry No. 128461); dirithromycin (CAS Registry No. 62013041); doxycycline (CAS Registry No. 17086281); emetine (NSC 33669; CAS Registry No. 483181); erythromycin (NSC 55929; CAS Registry No. 114078); flurithromycin (CAS Registry No. 83664208); framycetin (neomycin B; CAS Registry No. 119040); gentamycin (NSC 82261; CAS Registry No. 1403663); glycylcyclines, such as tigecycline (CAS Registry No. 220620097); hygromycin B (CAS Registry No. 31282049); isepamicin (CAS Registry No. 67814760); josamycin (NSC 122223; CAS Registry No. 16846245); kanamycin (CAS Registry No. 8063078); ketolides such as telithromycin (CAS Registry No. 191114484), cethromycin (CAS Registry No. 205110481), and solithromycin (CAS Registry No. 760981837); lincomycin (CAS Registry No. 154212); lymecycline (CAS Registry No. 992212); meclocycline (NSC 78502; CAS Registry No. 2013583); metacycline (rondomycin; NSC 356463; CAS Registry No. 914001); midecamycin (CAS Registry No. 35457808); minocycline (NSC 141993; CAS Registry No. 10118908); miocamycin (CAS Registry No. 55881077); neomycin (CAS Registry No. 119040); netilmicin (CAS Registry No. 56391561); oleandomycin (CAS Registry No. 3922905); oxazolidinones, such as eperezolid (CAS Registry No. 165800044), linezolid (CAS Registry No. 165800033), posizolid (CAS Registry No. 252260029), radezolid (CAS Registry No. 869884786), ranbezolid (CAS Registry No. 392659380), sutezolid (CAS Registry No. 168828588), tedizolid (CAS Registry No. 856867555); oxytetracycline (NSC 9169; CAS Registry No. 2058460); paromomycin (CAS Registry No. 7542372); penimepicycline (CAS Registry No. 4599604); peptidyl transferase inhibitors, e.g., chloramphenicol (NSC 3069; CAS Registry No. 56757) and derivatives such as azidamfenicol (CAS Registry No. 13838089), florfenicol (CAS Registry No. 73231342), and thiamphenicol (CAS Registry No. 15318453), and pleuromutilins such as retapamulin (CAS Registry No. 224452668), tiamulin (CAS Registry No. 55297955), valnemulin (CAS Registry No. 101312929); pirlimycin (CAS Registry No. 79548735); puromycin (NSC 3055; CAS Registry No. 53792); quinupristin (CAS Registry No. 120138503); ribostamycin (CAS Registry No. 53797356); rokitamycin (CAS Registry No. 74014510); rolitetracycline (CAS Registry No. 751973); roxithromycin (CAS Registry No. 80214831); sisomicin (CAS Registry No. 32385118); spectinomycin (CAS Registry No. 1695778); spiramycin (CAS Registry No. 8025818); streptogramins such as pristinamycin (CAS Registry No. 270076603), quinupristin/dalfopristin (CAS Registry No. 126602899), and virginiamycin (CAS Registry No. 11006761); streptomycin (CAS Registry No. 57921); tetracycline (NSC 108579; CAS Registry No. 60548); tobramycin (CAS Registry No. 32986564); troleandomycin (CAS Registry No. 2751099); tylosin (CAS Registry No. 1401690); verdamicin (CAS Registry No. 49863481).

Histone Deacetylase Inhibitors: abexinostat (CAS Registry No. 783355602); belinostat (NSC 726630; CAS Registry No. 414864009); chidamide (CAS Registry No. 743420022); entinostat (CAS Registry No. 209783802); givinostat (CAS Registry No. 732302997); mocetinostat (CAS Registry No. 726169739); panobinostat (CAS Registry No. 404950807); quisinostat (CAS Registry No. 875320299); resminostat (CAS Registry No. 864814880); romidepsin (CAS Registry No. 128517077); sulforaphane (CAS Registry No. 4478937); thioureidobutyronitrile (Kevetrin™; CAS Registry No. 6659890); valproic acid (NSC 93819; CAS Registry No. 99661); vorinostat (NSC 701852; CAS Registry No. 149647789); ACY-1215 (rocilinostat; CAS Registry No. 1316214524); CUDC-101 (CAS Registry No. 1012054599); CHR-2845 (tefinostat; CAS Registry No. 914382608); CHR-3996 (CAS Registry No. 1235859138); 4SC-202 (CAS Registry No. 910462430); CG200745 (CAS Registry No. 936221339); SB939 (pracinostat; CAS Registry No. 929016966).

Mitochondria Inhibitors: pancratistatin (NSC 349156; CAS Registry No. 96281311); rhodamine-123 (CAS Registry No. 63669709); edelfosine (NSC 324368; CAS Registry No. 70641519); d-alpha-tocopherol succinate (NSC 173849; CAS Registry No. 4345033); compound 11β (CAS Registry No. 865070377); aspirin (NSC 406186; CAS Registry No. 50782); ellipticine (CAS Registry No. 519233); berberine (CAS Registry No. 633658); cerulenin (CAS Registry No. 17397896); GX015-070 (Obatoclax®; 1H-Indole, 2-(2((3,5-dimethyl-1H-pyrrol-2-yl)methylene)-3-methoxy-2H-pyrrol-5-yl)-; NSC 729280; CAS Registry No. 803712676); celastrol (tripterine; CAS Registry No. 34157830); metformin (NSC 91485; CAS Registry No. 1115704); Brilliant green (NSC 5011; CAS Registry No. 633034); ME-344 (CAS Registry No. 1374524556).

Antimitotic Agents: allocolchicine (NSC 406042); auristatins, such as MMAE (monomethyl auristatin E; CAS Registry No. 474645-27-7) and MMAF (monomethyl auristatin F; CAS Registry No. 745017-94-1; halichondrin B (NSC 609395); colchicine (NSC 757; CAS Registry No. 64868); cholchicine derivative (N-benzoyl-deacetyl benzamide; NSC 33410; CAS Registry No. 63989753); dolastatin 10 (NSC 376128; CAS Registry No 110417-88-4); maytansine (NSC 153858; CAS Registry No. 35846-53-8); rhozoxin (NSC 332598; CAS Registry No. 90996546); taxol (NSC 125973; CAS Registry No. 33069624); taxol derivative ((2'-N-[3-(dimethylamino)propyl]glutaramate taxol; NSC 608832); thiocolchicine (3-demethylthiocolchicine; NSC 361792); trityl cysteine (NSC 49842; CAS Registry No. 2799077); vinblastine sulfate (NSC 49842; CAS Registry No. 143679); vincristine sulfate (NSC 67574; CAS Registry No. 2068782).

Any of these agents that include or that can be modified to include a site of attachment to a CD2 binding molecule can be included in the ADCs disclosed herein.

In some embodiments, the cytotoxic and/or cytostatic agent is an antimitotic agent.

In some embodiments, the cytotoxic and/or cytostatic agent is an auristatin, for example, monomethyl auristatin E ("MMAE:) or monomethyl auristatin F ("MMAF").

7.13.2. ADC Linkers

In the ADCs of the disclosure, the cytotoxic and/or cytostatic agents are linked to the CD2 binding molecule by way of ADC linkers. The ADC linker linking a cytotoxic and/or cytostatic agent to the CD2 binding molecule of an ADC can be short, long, hydrophobic, hydrophilic, flexible or rigid, or can be composed of segments that each independently have one or more of the above-mentioned properties such that the linker can include segments having different properties. The linkers can be polyvalent such that they covalently link more than one agent to a single site on the CD2 binding molecule, or monovalent such that covalently they link a single agent to a single site on the CD2 binding molecule.

As will be appreciated by a skilled artisan, the ADC linkers link cytotoxic and/or cytostatic agents to the CD2 binding molecule by forming a covalent linkage to the cytotoxic and/or cytostatic agent at one location and a covalent linkage to the CD2 binding molecule at another. The covalent linkages are formed by reaction between functional groups on the ADC linker and functional groups on the agents and CD2 binding molecule. As used herein, the expression "ADC linker" is intended to include (i) unconjugated forms of the ADC linker that include a functional group capable of covalently linking the ADC linker to a cytotoxic and/or cytostatic agent and a functional group capable of covalently linking the ADC linker to a CD2 binding molecule; (ii) partially conjugated forms of the ADC linker that include a functional group capable of covalently linking the ADC linker to a CD2 binding molecule and that is covalently linked to a cytotoxic and/or cytostatic agent, or vice versa; and (iii) fully conjugated forms of the ADC linker that are covalently linked to both a cytotoxic and/or cytostatic agent and a CD2 binding molecule. In some embodiments of ADC linkers and ADCs of the disclosure, as well as synthons used to conjugate linker-agents to CD2 binding molecules, moieties comprising the functional groups on the ADC linker and covalent linkages formed between the ADC linker and CD2 binding molecule are specifically illustrated as $R_x$ and XY, respectively.

The ADC linkers can, but need not be, chemically stable to conditions outside the cell, and can be designed to cleave, immolate and/or otherwise specifically degrade inside the cell. Alternatively, ADC linkers that are not designed to specifically cleave or degrade inside the cell can be used. Choice of stable versus unstable ADC linker can depend upon the toxicity of the cytotoxic and/or cytostatic agent. For agents that are toxic to normal cells, stable linkers can be used. Agents that are selective or targeted and have lower toxicity to normal cells can utilize, chemical stability of the ADC linker to the extracellular milieu is less important. A wide variety of ADC linkers useful for linking drugs to CD2 binding molecules in the context of ADCs are known. Any of these ADC linkers, as well as other ADC linkers, can be used to link the cytotoxic and/or cytostatic agents to the CD2 binding molecule of the ADCs of the disclosure.

Exemplary polyvalent ADC linkers that can be used to link many cytotoxic and/or cytostatic agents to a single CD2 binding molecule are described, for example, in WO 2009/073445; WO 2010/068795; WO 2010/138719; WO 2011/120053; WO 2011/171020; WO 2013/096901; WO 2014/008375; WO 2014/093379; WO 2014/093394; WO 2014/093640. For example, the Fleximer linker technology developed by Mersana et al. has the potential to enable high-DAR ADCs with good physicochemical properties. As shown below, the Mersana technology is based on incorporating drug molecules into a solubilizing poly-acetal backbone via a sequence of ester bonds. The methodology renders highly-loaded ADCs (DAR up to 20) while maintaining good physicochemical properties.

Additional examples of dendritic type linkers can be found in US 2006/116422; US 2005/271615; de Groot et al., 2003, Angew. Chem. Int. Ed. 42:4490-4494; Amir et al., 2003, Angew. Chem. Int. Ed. 42:4494-4499; Shamis et al., 2004, J. Am. Chem. Soc. 126:1726-1731; Sun et al., 2002, Bioorganic & Medicinal Chemistry Letters 12:2213-2215; Sun et al., 2003, Bioorganic & Medicinal Chemistry 11:1761-1768; King et al., 2002, Tetrahedron Letters 43:1987-1990.

Exemplary monovalent ADC linkers that can be used are described, for example, in Nolting, 2013, Antibody-Drug Conjugates, Methods in Molecular Biology 1045:71-100; Kitson et al., 2013, CROs-MOs--Chemica-ggi—Chemistry Today 31(4):30-38; Ducry et al., 2010, Bioconjugate Chem. 21:5-13; Zhao et al., 2011, J. Med. Chem. 54:3606-3623; U.S. Pat. Nos. 7,223,837; 8,568,728; 8,535,678; and WO2004010957.

By way of example and not limitation, some cleavable and noncleavable ADC linkers that can be included in the ADCs are described below.

7.13.2.1. Cleavable ADC Linkers

In certain embodiments, the ADC linker selected is cleavable in vivo. Cleavable ADC linkers can include chemically or enzymatically unstable or degradable linkages. Cleavable ADC linkers generally rely on processes inside the cell to liberate the drug, such as reduction in the cytoplasm, exposure to acidic conditions in the lysosome, or cleavage by specific proteases or other enzymes within the cell. Cleavable ADC linkers generally incorporate one or more chemical bonds that are either chemically or enzymatically cleavable while the remainder of the ADC linker is noncleavable. In certain embodiments, an ADC linker comprises a chemically labile group such as hydrazone and/or disulfide groups. Linkers comprising chemically labile groups exploit differential properties between the plasma and some cytoplasmic compartments. The intracellular conditions to facilitate drug release for hydrazone containing ADC linkers are the acidic environment of endosomes and lysosomes, while the disulfide containing ADC linkers are reduced in the cytosol, which contains high thiol concentrations, e.g., glutathione. In certain embodiments, the plasma stability of an ADC linker comprising a chemically labile group can be increased by introducing steric hindrance using substituents near the chemically labile group.

Acid-labile groups, such as hydrazone, remain intact during systemic circulation in the blood's neutral pH environment (pH 7.3-7.5) and undergo hydrolysis and release the drug once the ADC is internalized into mildly acidic endosomal (pH 5.0-6.5) and lysosomal (pH 4.5-5.0) compartments of the cell. This pH dependent release mechanism has been associated with nonspecific release of the drug. To increase the stability of the hydrazone group of the ADC linker, the ADC linker can be varied by chemical modification, e.g., substitution, allowing tuning to achieve more efficient release in the lysosome with a minimized loss in circulation.

Hydrazone-containing ADC linkers can contain additional cleavage sites, such as additional acid-labile cleavage sites and/or enzymatically labile cleavage sites. ADCs including exemplary hydrazone-containing ADC linkers include the following structures:

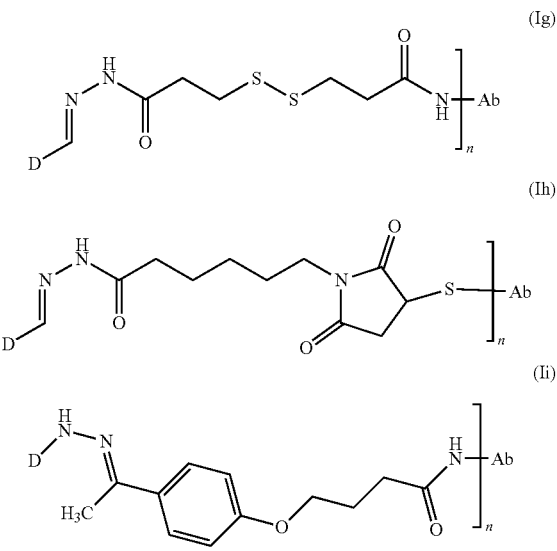

where D and Ab represent the cytotoxic and/or cytostatic agent (drug) and Ab, respectively, and n represents the number of drug-ADC linkers linked to the CD2 binding molecule. In certain ADC linkers such as linker (Ig), the ADC linker comprises two cleavable groups—a disulfide and a hydrazone moiety. For such ADC linkers, effective release of the unmodified free drug requires acidic pH or disulfide reduction and acidic pH. Linkers such as (Ih) and (Ii) have been shown to be effective with a single hydrazone cleavage site.

Additional ADC linkers which remain intact during systemic circulation and undergo hydrolysis and release the drug when the ADC is internalized into acidic cellular compartments include carbonates. Such ADC linkers can be useful in cases where the cytotoxic and/or cytostatic agent can be covalently attached through an oxygen.

Other acid-labile groups that can be included in ADC linkers include cis-aconityl-containing ADC linkers. cis-Aconityl chemistry uses a carboxylic acid juxtaposed to an amide bond to accelerate amide hydrolysis under acidic conditions.

Cleavable ADC linkers can also include a disulfide group. Disulfides are thermodynamically stable at physiological pH and are designed to release the drug upon internalization inside cells, where the cytosol provides a significantly more reducing environment compared to the extracellular environment. Scission of disulfide bonds generally requires the presence of a cytoplasmic thiol cofactor, such as (reduced) glutathione (GSH), such that disulfide-containing ADC linkers are reasonably stable in circulation, selectively releasing the drug in the cytosol. The intracellular enzyme protein disulfide isomerase, or similar enzymes capable of cleaving disulfide bonds, can also contribute to the preferential cleavage of disulfide bonds inside cells. GSH is reported to be present in cells in the concentration range of 0.5-10 mM compared with a significantly lower concentration of GSH or cysteine, the most abundant low-molecular weight thiol, in circulation at approximately 5 Tumor cells, where irregular blood flow leads to a hypoxic state, result in enhanced activity of reductive enzymes and therefore even higher glutathione concentrations. In certain embodiments, the in vivo stability of a disulfide-containing ADC linker can be enhanced by chemical modification of the ADC linker, e.g., use of steric hindrance adjacent to the disulfide bond.

ADCs including exemplary disulfide-containing ADC linkers include the following structures:

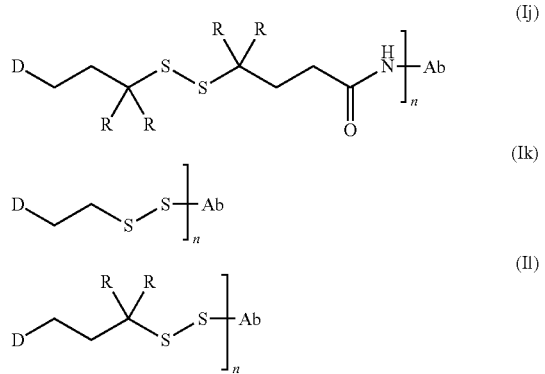

where D and Ab represent the drug and CD2 binding molecule, respectively, n represents the number of drug-ADC linkers linked to the CD2 binding molecule and R is independently selected at each occurrence from hydrogen or alkyl, for example. In certain embodiments, increasing steric hindrance adjacent to the disulfide bond increases the stability of the ADC linker. Structures such as (Id and (II) show increased in vivo stability when one or more R groups is selected from a lower alkyl such as methyl.

Another type of cleavable ADC linker that can be used is an ADC linker that is specifically cleaved by an enzyme. Such ADC linkers are typically peptide-based or include peptidic regions that act as substrates for enzymes. Peptide based ADC linkers tend to be more stable in plasma and extracellular milieu than chemically labile ADC linkers. Peptide bonds generally have good serum stability, as lysosomal proteolytic enzymes have very low activity in blood due to endogenous inhibitors and the unfavorably high pH value of blood compared to lysosomes. Release of a drug from a CD2 binding molecule occurs specifically due to the action of lysosomal proteases, e.g., cathepsin and plasmin. These proteases can be present at elevated levels in certain tumor cells.

In exemplary embodiments, the cleavable peptide is selected from tetrapeptides such as Gly-Phe-Leu-Gly, (SEQ ID NO: 1003), Ala-Leu-Ala-Leu (SEQ ID NO: 1004) or dipeptides such as Val-Cit, Val-Ala, Met-(D)Lys, Asn-(D)Lys, Val-(D)Asp, Phe-Lys, Ile-Val, Asp-Val, His-Val, Nor-Val-(D)Asp, Ala-(D)Asp 5, Met-Lys, Asn-Lys, Ile-Pro, Me3Lys-Pro, PhenylGly-(D)Lys, Met-(D)Lys, Asn-(D)Lys, Pro-(D)Lys, Met-(D)Lys, Asn-(D)Lys, AM Met-(D)Lys, Asn-(D)Lys, AW Met-(D)Lys, and Asn-(D)Lys. In certain embodiments, dipeptides can be selected over longer polypeptides due to hydrophobicity of the longer peptides.

A variety of dipeptide-based cleavable ADC linkers useful for linking drugs such as doxorubicin, mitomycin, camptothecin, pyrrolobenzodiazepine, tallysomycin and auristatin/auristatin family members to CD2 binding molecules have been described (see, Dubowchik et al., 1998, J. Org. Chem. 67:1866-1872; Dubowchik et al., 1998, Bioorg. Med. Chem. Lett. 8(21):3341-3346; Walker et al., 2002, Bioorg. Med. Chem. Lett. 12:217-219; Walker et al., 2004, Bioorg. Med. Chem. Lett. 14:4323-4327; Sutherland et al., 2013, Blood 122: 1455-1463; and Francisco et al., 2003, Blood 102:1458-1465). All of these dipeptide ADC linkers, or modified versions of these dipeptide ADC linkers, can be used in the ADCs of the disclosure. Other dipeptide ADC linkers that can be used include those found in ADCs such as Seattle Genetics' Brentuximab Vendotin SGN-35 (Adcetris™), Seattle Genetics SGN-75 (anti-CD-70, Val-Cit-monomethyl auristatin F(MMAF), Seattle Genetics SGN-CD33A (anti-CD-33, Val-Ala-(SGD-1882)), Celldex Therapeutics glembatumumab (CDX-011) (anti-NMB, Val-Cit-monomethyl auristatin E (MMAE), and Cytogen PSMA-ADC (PSMA-ADC-1301) (anti-PSMA, Val-Cit-MMAE).

Enzymatically cleavable ADC linkers can include a self-immolative spacer to spatially separate the drug from the site of enzymatic cleavage. The direct attachment of a drug to a peptide ADC linker can result in proteolytic release of an amino acid adduct of the drug, thereby impairing its activity. The use of a self-immolative spacer allows for the elimination of the fully active, chemically unmodified drug upon amide bond hydrolysis.

One self-immolative spacer is the bifunctional para-aminobenzyl alcohol group, which is linked to the peptide through the amino group, forming an amide bond, while amine containing drugs can be attached through carbamate functionalities to the benzylic hydroxyl group of the ADC linker (PABC). The resulting prodrugs are activated upon protease-mediated cleavage, leading to a 1,6-elimination reaction releasing the unmodified drug, carbon dioxide, and remnants of the ADC linker group. The following scheme depicts the fragmentation of p-amidobenzyl ether and release of the drug:

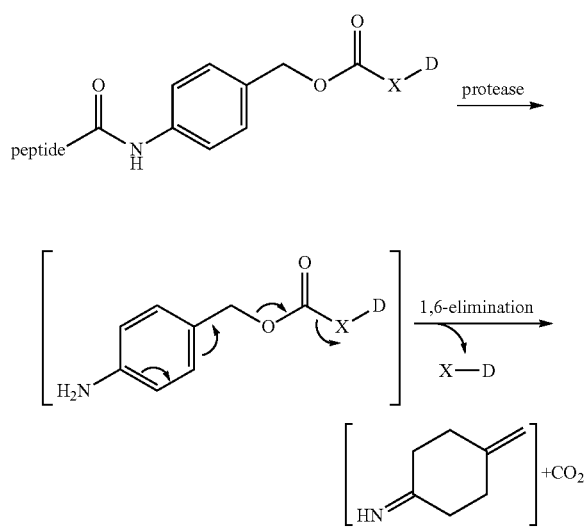

where X-D represents the unmodified drug.

Heterocyclic variants of this self-immolative group have also been described. See for example, U.S. Pat. No. 7,989,434.

In some embodiments, the enzymatically cleavable ADC linker is a β-glucuronic acid-based ADC linker. Facile release of the drug can be realized through cleavage of the β-glucuronide glycosidic bond by the lysosomal enzyme β-glucuronidase. This enzyme is present abundantly within lysosomes and is overexpressed in some tumor types, while the enzyme activity outside cells is low. β-Glucuronic acid-based ADC linkers can be used to circumvent the tendency of an ADC to undergo aggregation due to the hydrophilic nature of β-glucuronides. In some embodiments, β-glucuronic acid-based ADC linkers can be used as ADC linkers for ADCs linked to hydrophobic drugs. The following scheme depicts the release of the drug from and ADC containing a β-glucuronic acid-based ADC linker:

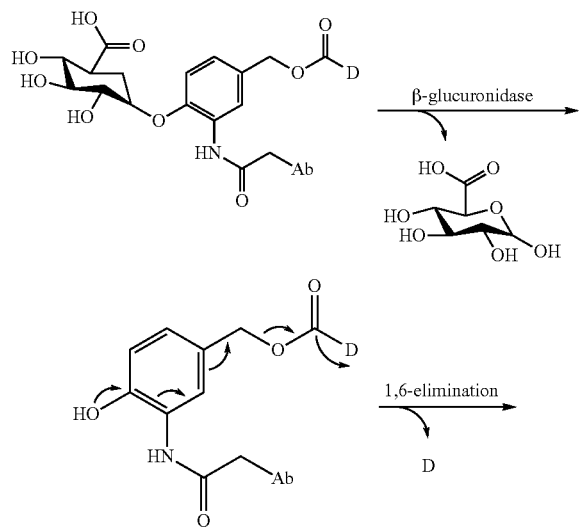

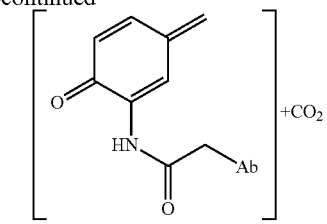

A variety of cleavable β-glucuronic acid-based ADC linkers useful for linking drugs such as auristatins, camptothecin and doxorubicin analogues, CBI minor-groove binders, and psymberin to CD2 binding molecules have been described (see, Nolting, Chapter 5 "Linker Technology in Antibody-Drug Conjugates," In: Antibody-Drug Conjugates: Methods in Molecular Biology, vol. 1045, pp. 71-100, Laurent Ducry (Ed.), Springer Science & Business Medica, LLC, 2013; Jeffrey et al., 2006, Bioconjug. Chem. 17:831-840; Jeffrey et al., 2007, Bioorg. Med. Chem. Lett. 17:2278-2280; and Jiang et al., 2005, J. Am. Chem. Soc. 127:11254-11255). All of these β-glucuronic acid-based ADC linkers can be used in the ADCs of the disclosure.

Additionally, cytotoxic and/or cytostatic agents containing a phenol group can be covalently bonded to an ADC linker through the phenolic oxygen. One such ADC linker, described in WO 2007/089149, relies on a methodology in which a diamino-ethane "SpaceLink" is used in conjunction with traditional "PABO"-based self-immolative groups to deliver phenols. The cleavage of the ADC linker is depicted schematically below, where D represents a cytotoxic and/or cytostatic agent having a phenolic hydroxyl group.

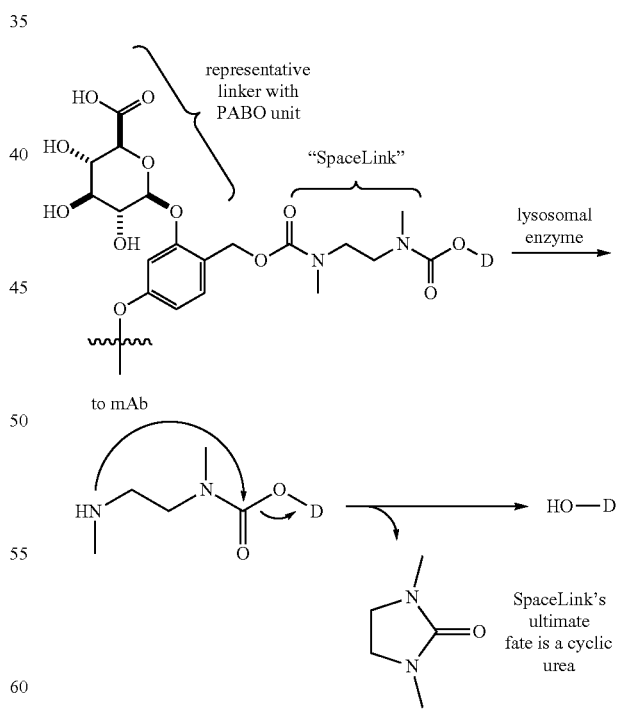

Cleavable ADC linkers can include noncleavable portions or segments, and/or cleavable segments or portions can be included in an otherwise non-cleavable ADC linker to render it cleavable. By way of example only, polyethylene glycol (PEG) and related polymers can include cleavable groups in the polymer backbone. For example, a polyethylene glycol or polymer ADC linker can include one or more cleavable groups such as a disulfide, a hydrazone or a dipeptide.

Other degradable linkages that can be included in ADC linkers include ester linkages formed by the reaction of PEG carboxylic acids or activated PEG carboxylic acids with alcohol groups on a biologically active agent, where such ester groups generally hydrolyze under physiological conditions to release the biologically active agent. Hydrolytically degradable linkages include, but are not limited to, carbonate linkages; imine linkages resulting from reaction of an amine and an aldehyde; phosphate ester linkages formed by reacting an alcohol with a phosphate group; acetal linkages that are the reaction product of an aldehyde and an alcohol; orthoester linkages that are the reaction product of a formate and an alcohol; and oligonucleotide linkages formed by a phosphoramidite group, including but not limited to, at the end of a polymer, and a 5' hydroxyl group of an oligonucleotide.

In certain embodiments, the ADC linker comprises an enzymatically cleavable peptide moiety, for example, an ADC linker comprising structural formula (IVa) or (IVb):

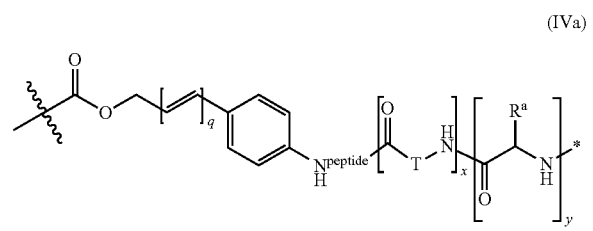

(IVa)

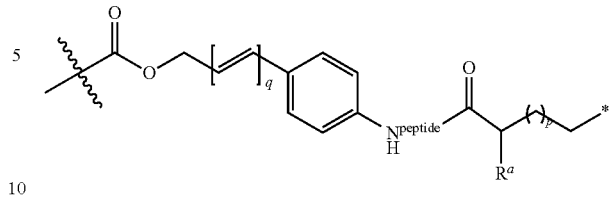

(IVb)

or a salt thereof, where: peptide represents a peptide (illustrated C→N and not showing the carboxy and amino "termini") cleavable by a lysosomal enzyme; T represents a polymer comprising one or more ethylene glycol units or an alkylene chain, or combinations thereof; $R^a$ is selected from hydrogen, alkyl, sulfonate and methyl sulfonate; p is an integer ranging from 0 to 5; q is 0 or 1; x is 0 or 1; y is 0 or 1; † represents the point of attachment of the ADC linker to a cytotoxic and/or cytostatic agent; and * represents the point of attachment to the remainder of the ADC linker.

In certain embodiments, the peptide is selected from a tripeptide or a dipeptide. In particular embodiments, the dipeptide is selected from: Val-Cit; Cit-Val; Ala-Ala; Ala-Cit; Cit-Ala; Asn-Cit; Cit-Asn; Cit-Cit; Val-Glu; Glu-Val; Ser-Cit; Cit-Ser; Lys-Cit; Cit-Lys; Asp-Cit; Cit-Asp; Ala-Val; Val-Ala; Phe-Lys; Val-Lys; Ala-Lys; Phe-Cit; Leu-Cit; Ile-Cit; Phe-Arg; and Trp-Cit. In certain embodiments, the dipeptide is selected from: Cit-Val; and Ala-Val.

Specific exemplary embodiments of ADC linkers according to structural formula (IVa) that can be included in the ADCs include the ADC linkers illustrated below (as illustrated, the ADC linkers include a group suitable for covalently linking the ADC linker to a CD2 binding molecule):

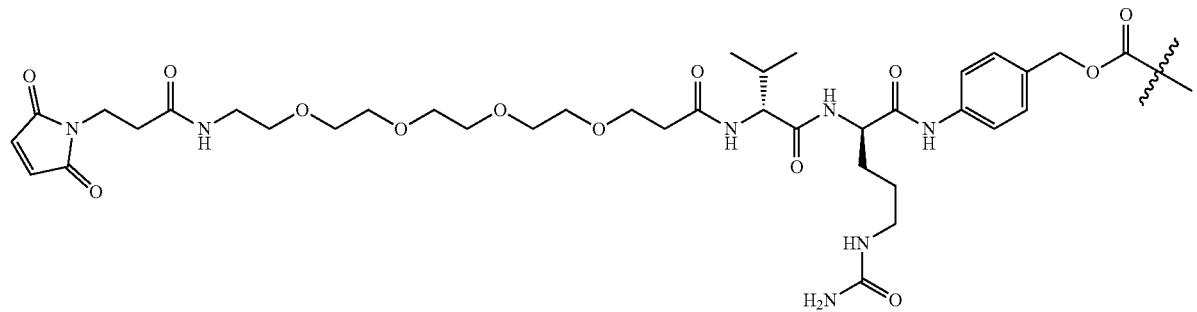

(IVa.1)

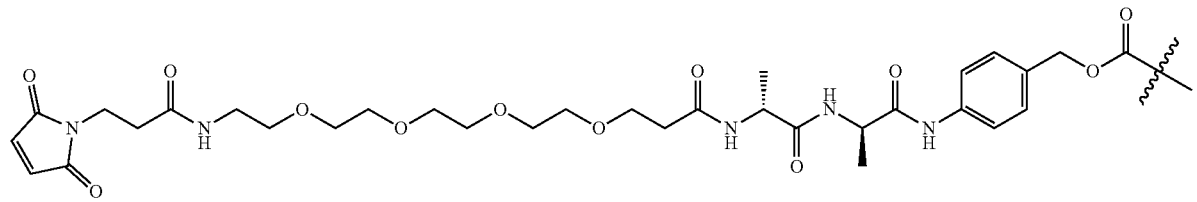

(IVa.2)

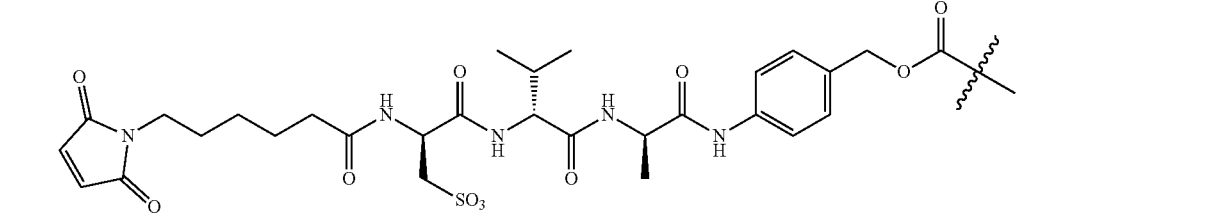

(IVa.3)

-continued
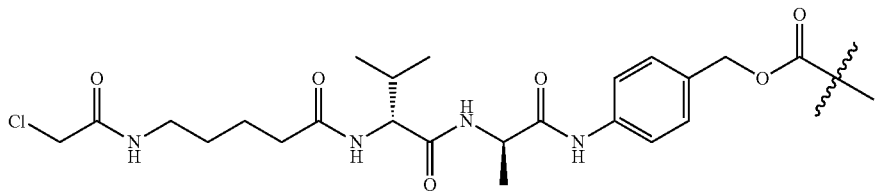
(IVa.4)
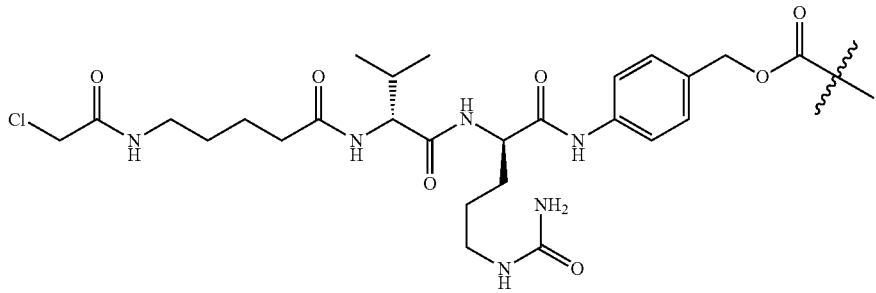
(IVa.5)
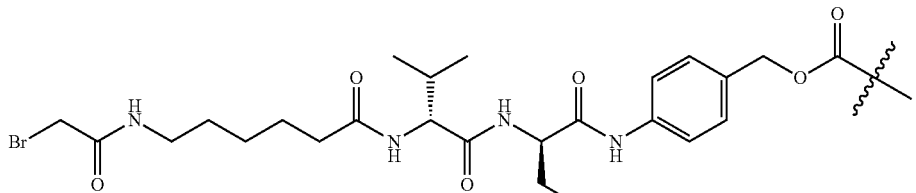
(IVa.6)
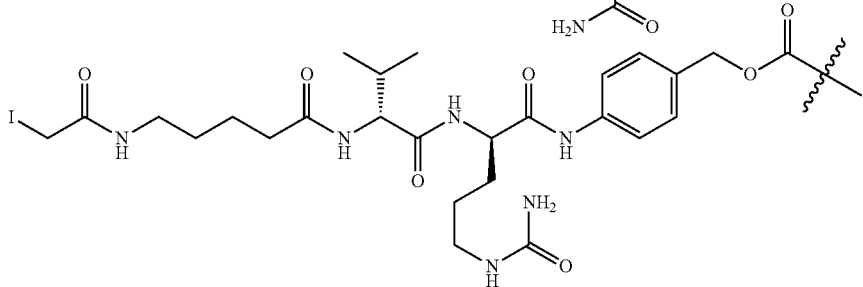
(IVa.7)
Specific exemplary embodiments of ADC linkers according to structural formula (IVb) that can be included in the ADCs include the ADC linkers illustrated below (as illustrated, the ADC linkers include a group suitable for covalently linking the ADC linker to a CD2 binding molecule):
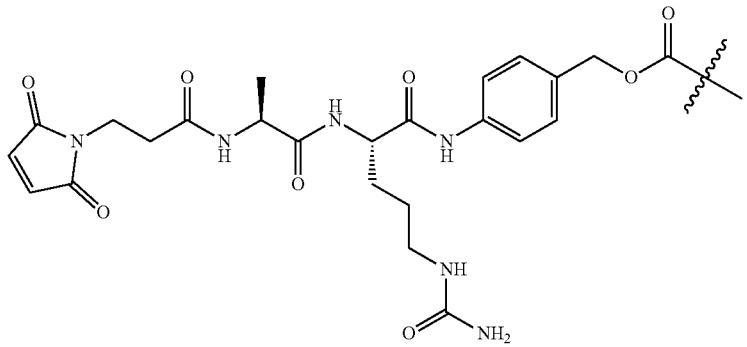
(IVb.1)

-continued
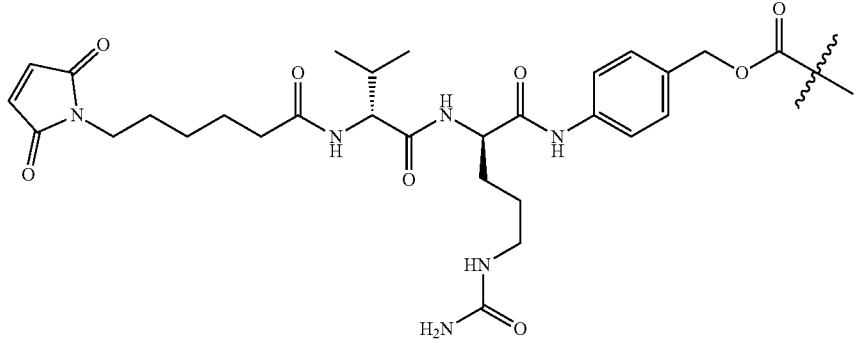
(IVb.2)
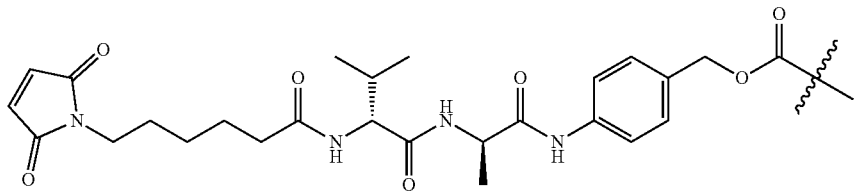
(IVb.3)
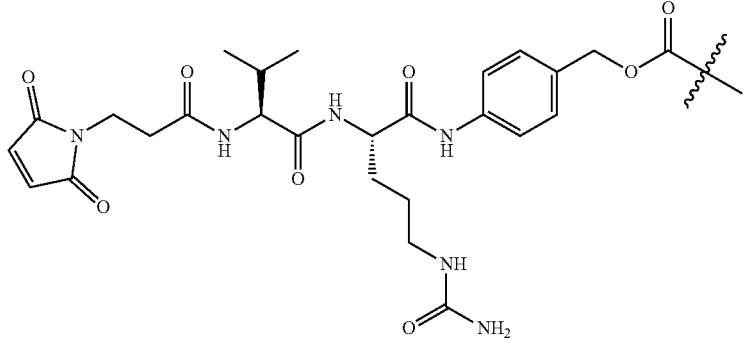
(IVb.4)
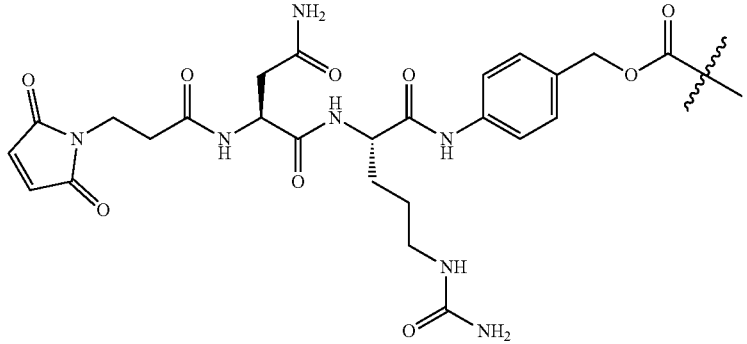
(IVb.5)
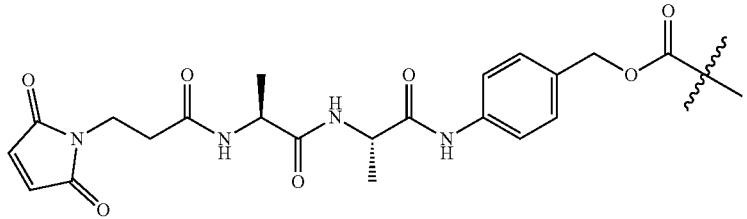
(IVb.6)

-continued
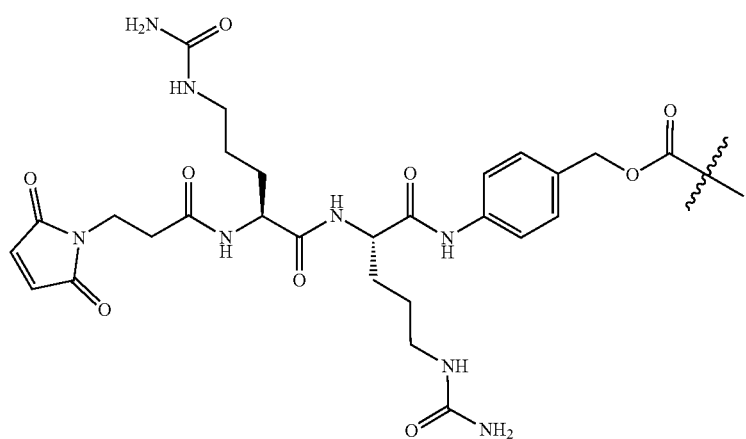
(IVb.7)
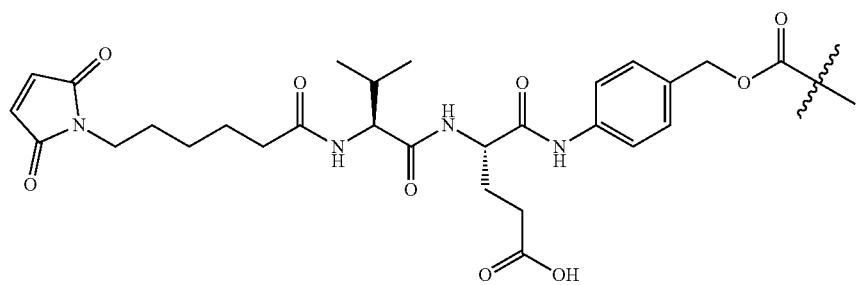
(IVb.8)
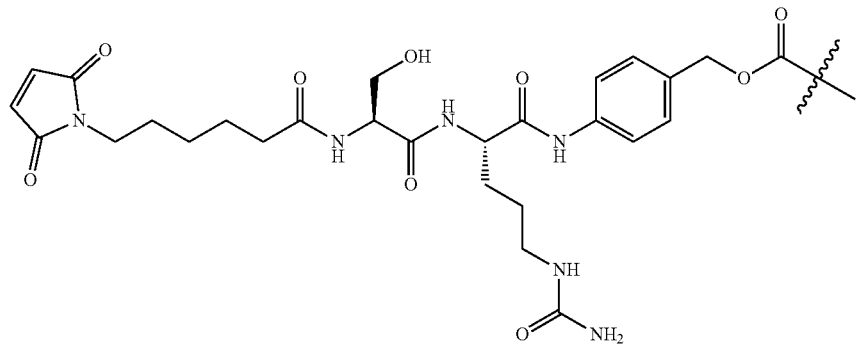
(IVb.9)
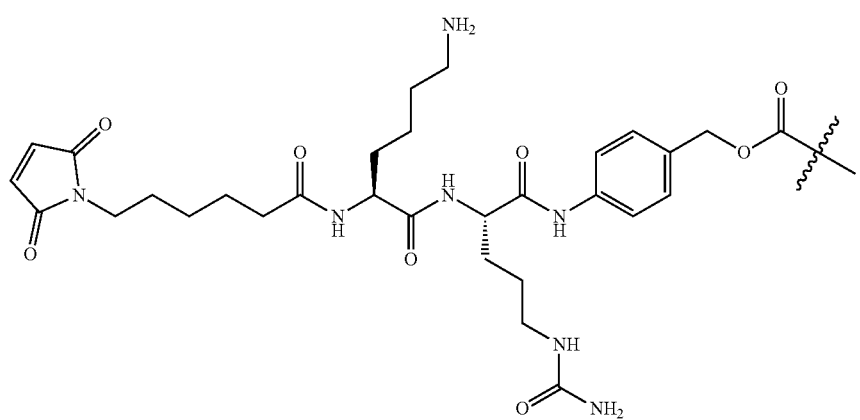
(IVb.10)

-continued
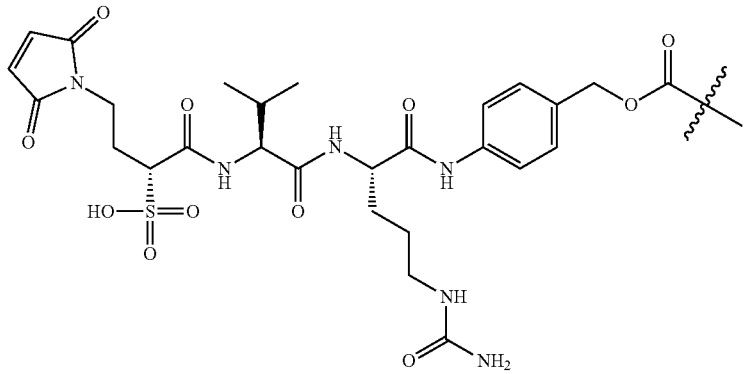
(IVb.11)
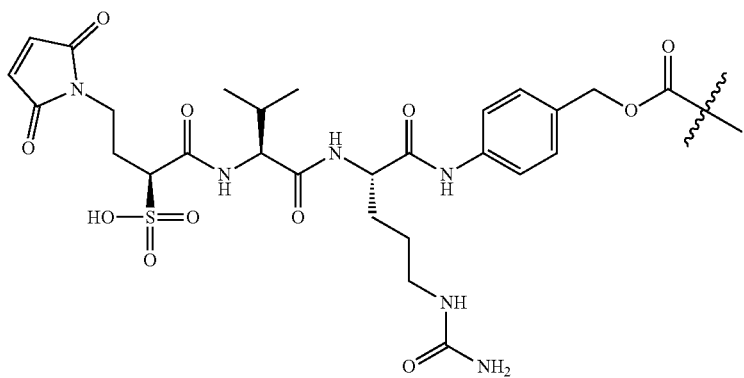
(IVb.12)
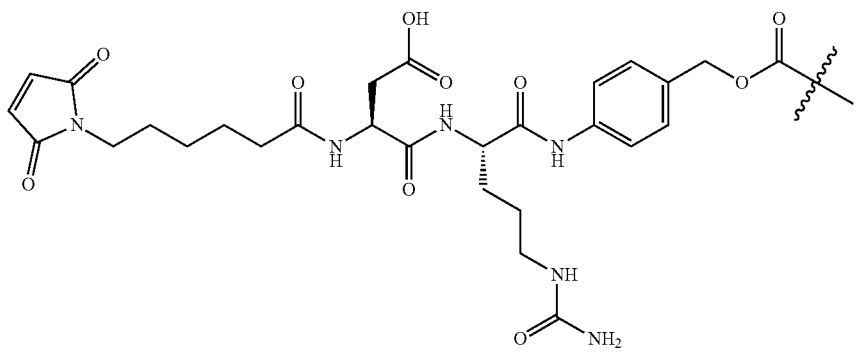
(IVb.13)
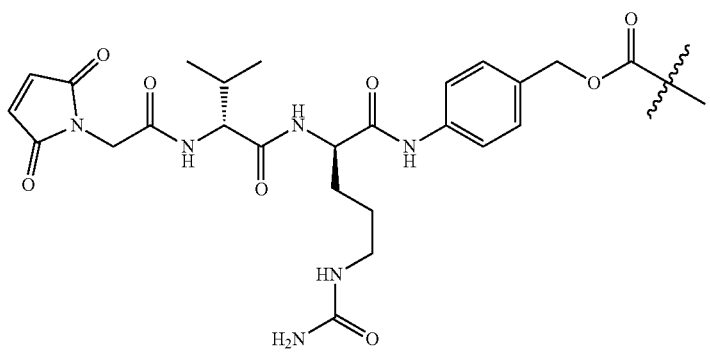
(IVb.14)

-continued
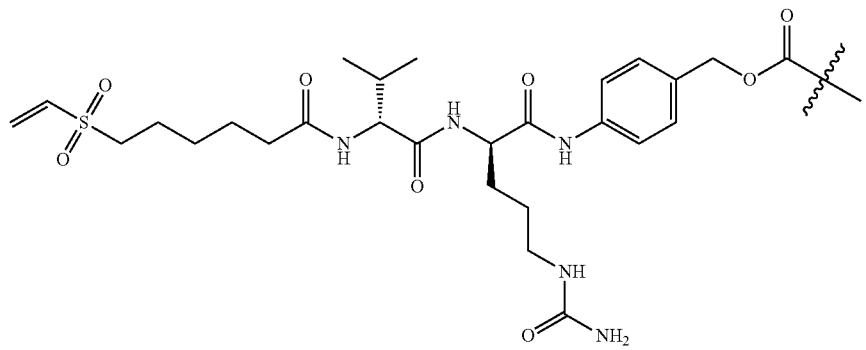
(IVb.15)
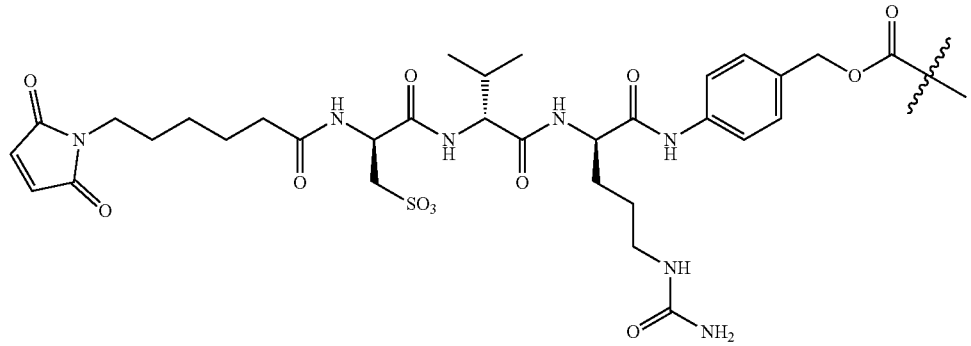
(IVb.16)
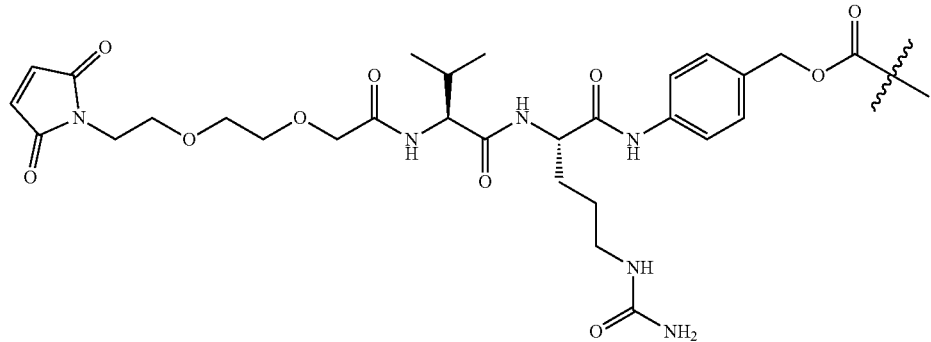
(IVb.17)
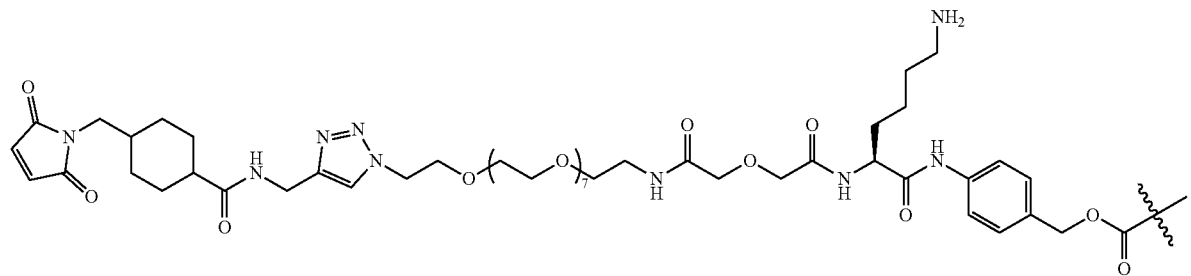
(IVb.18)
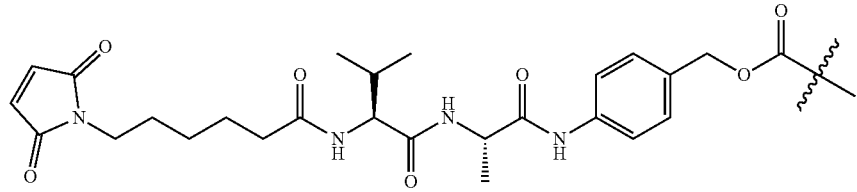
(IVb.19)

In certain embodiments, the ADC linker comprises an enzymatically cleavable peptide moiety, for example, an ADC linker comprising structural formula (IVc) or (IVd):

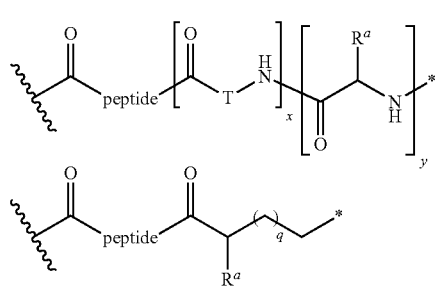
(IVc)

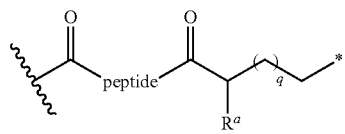
(IVd)

or a salt thereof, where: peptide represents a peptide (illustrated C→N and not showing the carboxy and amino "termini") cleavable by a lysosomal enzyme; T represents a polymer comprising one or more ethylene glycol units or an alkylene chain, or combinations thereof; Ra is selected from hydrogen, alkyl, sulfonate and methyl sulfonate; p is an integer ranging from 0 to 5; q is 0 or 1; x is 0 or 1; y is 0 or 1; .x ′ represents the point of attachment of the ADC linker to a cytotoxic and/or cytostatic agent; and * represents the point of attachment to the remainder of the ADC linker.

Specific exemplary embodiments of ADC linkers according to structural formula (IVc) that can be included in the ADCs include the ADC linkers illustrated below (as illustrated, the ADC linkers include a group suitable for covalently linking the ADC linker to a CD2 binding molecule):

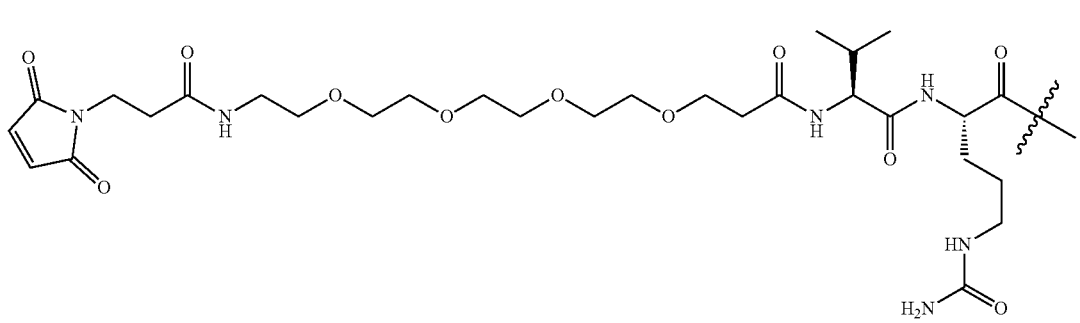
(IVc.1)

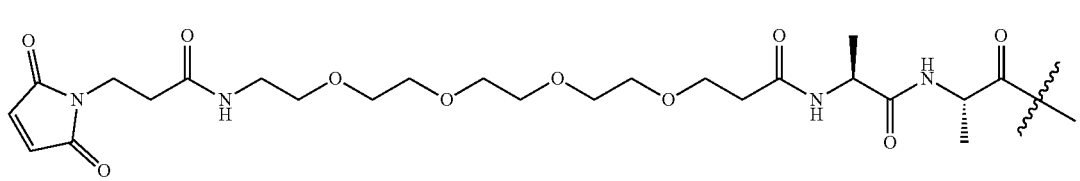
(IVc.2)

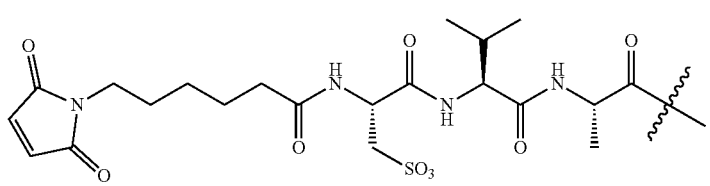
(IVc.3)

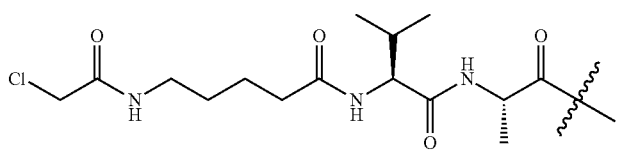
(IVc.4)

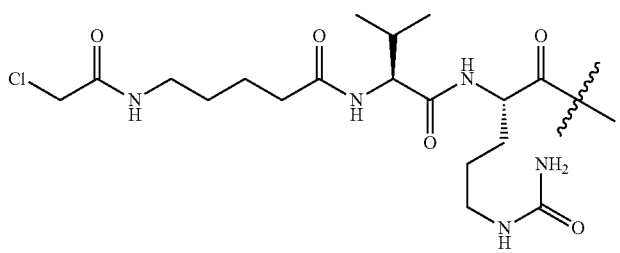
(IVc.5)

-continued
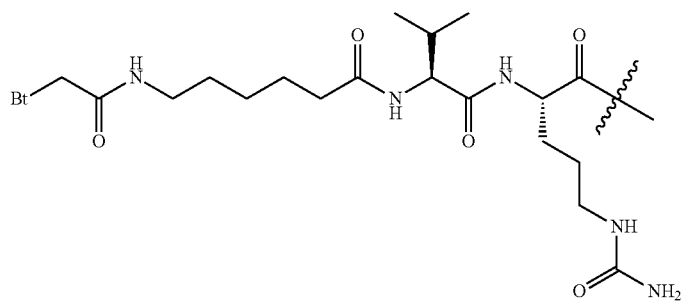
(IVc.6)
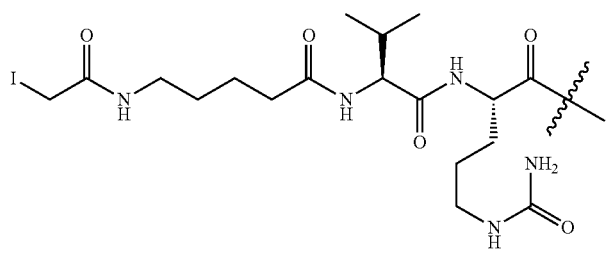
(IVc.7)
Specific exemplary embodiments of ADC linkers according to structural formula (IVd) that can be included in the ADCs include the ADC linkers illustrated below (as illustrated, the ADC linkers include a group suitable for covalently linking the ADC linker to a CD2 binding molecule):
(IVd.1)
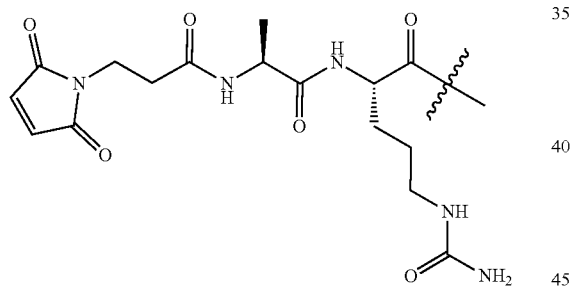
(IVd.2)
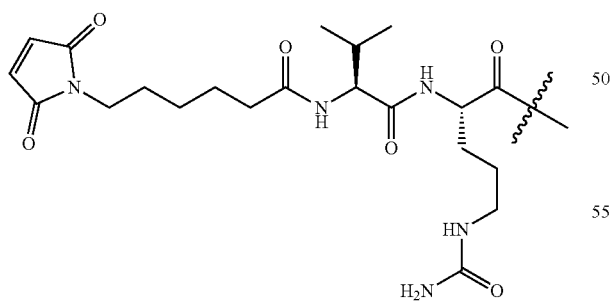
(IVd.3)
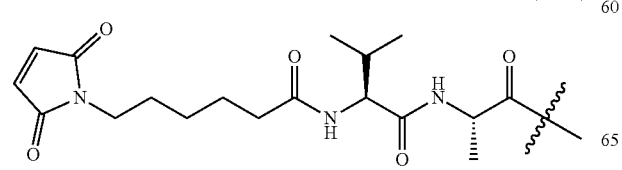
-continued
(IVd.4)
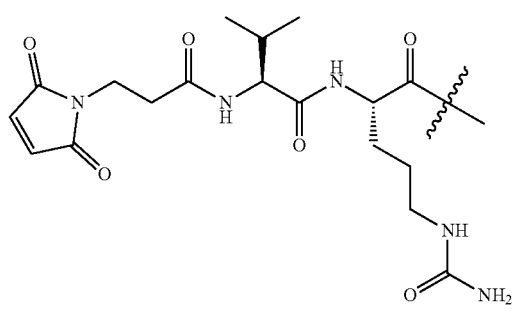
(IVd.5)
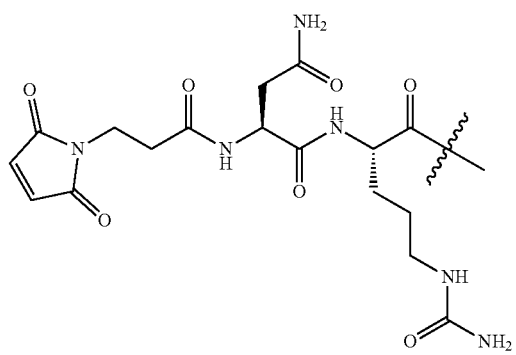
(IVd.6)
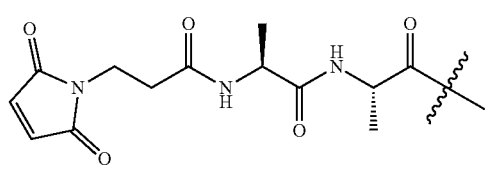

(IVd.7)
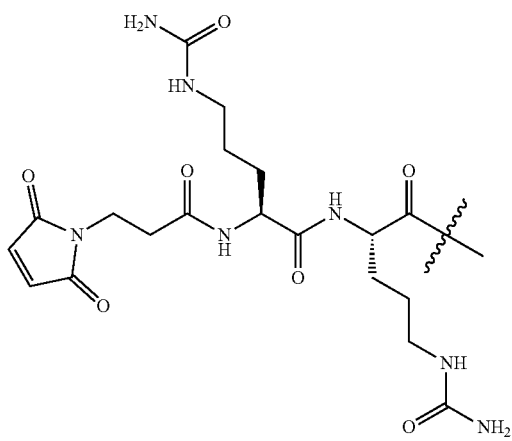
(IVd.8)
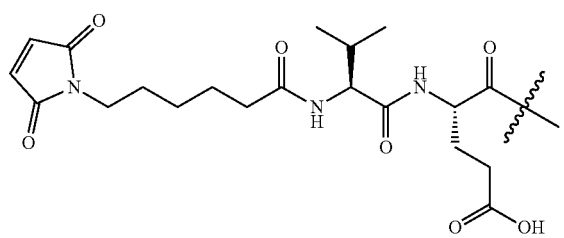
(IVd.9)
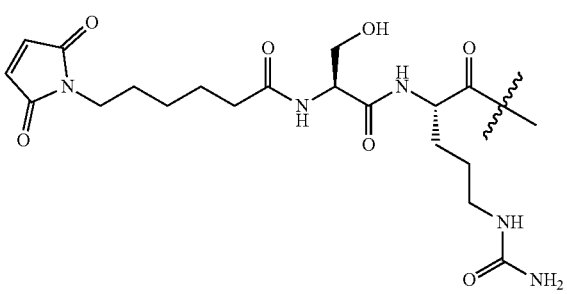
(IVd.10)
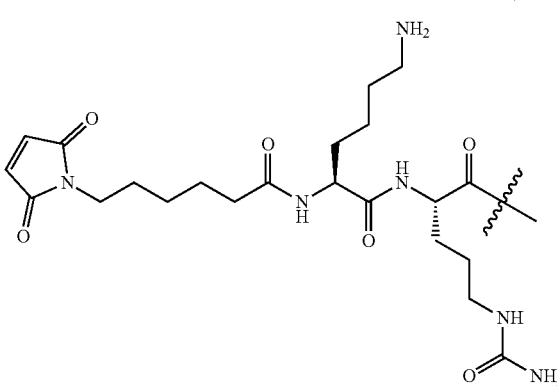
(IVd.11)
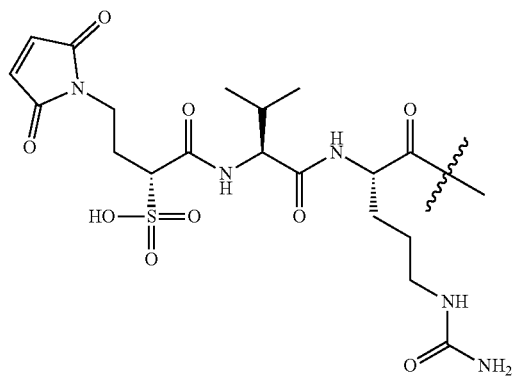
(IVd.12)
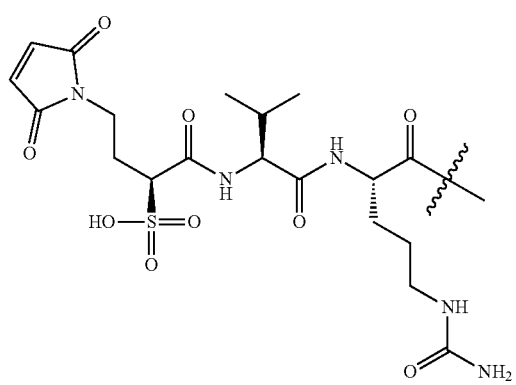
(IVd.13)
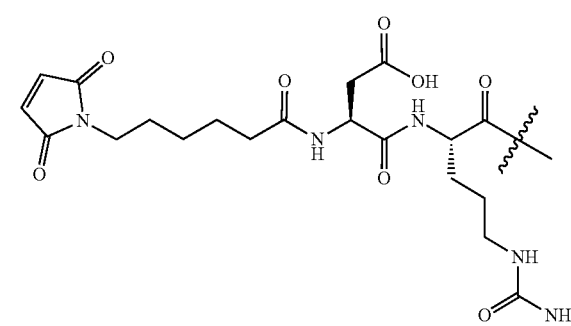
(IVd.14)
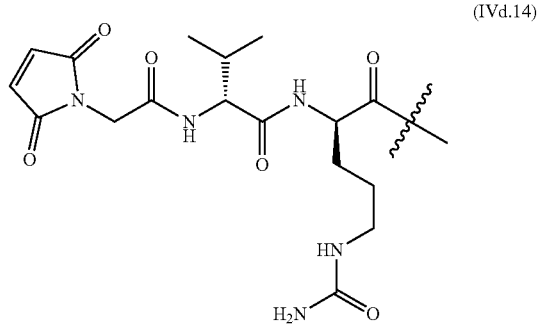

-continued

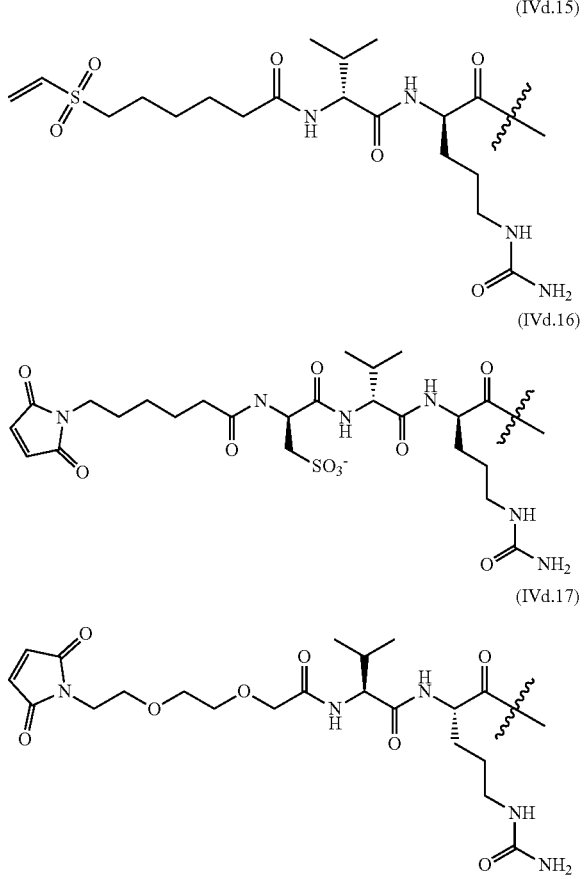

(IVd.15)

(IVd.16)

(IVd.17)

In certain embodiments, the ADC linker comprising structural formula (IVa), (IVb), (IVc), or (IVd) further comprises a carbonate moiety cleavable by exposure to an acidic medium. In particular embodiments, the ADC linker is attached through an oxygen to a cytotoxic and/or cytostatic agent.

7.13.2.2. Non-Cleavable Linkers

Although cleavable ADC linkers can provide certain advantages, the ADC linkers comprising the ADCs need not be cleavable. For noncleavable ADC linkers, the release of drug does not depend on the differential properties between the plasma and some cytoplasmic compartments. The release of the drug is postulated to occur after internalization of the ADC via antigen-mediated endocytosis and delivery to lysosomal compartment, where the CD2 binding molecule is degraded to the level of amino acids through intracellular proteolytic degradation. This process releases a drug derivative, which is formed by the drug, the ADC linker, and the amino acid residue to which the ADC linker was covalently attached. The amino acid drug metabolites from conjugates with noncleavable ADC linkers are more hydrophilic and generally less membrane permeable, which leads to less bystander effects and less nonspecific toxicities compared to conjugates with a cleavable ADC linker. In general, ADCs with noncleavable ADC linkers have greater stability in circulation than ADCs with cleavable ADC linkers. Non-cleavable ADC linkers can be alkylene chains, or can be polymeric in natures, such as, for example, based upon polyalkylene glycol polymers, amide polymers, or can include segments of alkylene chains, polyalkylene glocols and/or amide polymers.

A variety of non-cleavable ADC linkers used to link drugs to CD2 binding molecules have been described. See, Jeffrey et al., 2006, Bioconjug. Chem. 17; 831-840; Jeffrey et al., 2007, Bioorg. Med. Chem. Lett. 17:2278-2280; and Jiang et al., 2005, J. Am. Chem. Soc. 127:11254-11255. All of these ADC linkers can be included in the ADCs of the disclosure.

In certain embodiments, the ADC linker is non-cleavable in vivo, for example an ADC linker according to structural formula (VIa), (VIb), (VIc) or (VId) (as illustrated, the ADC linkers include a group suitable for covalently linking the ADC linker to a CD2 binding molecule:

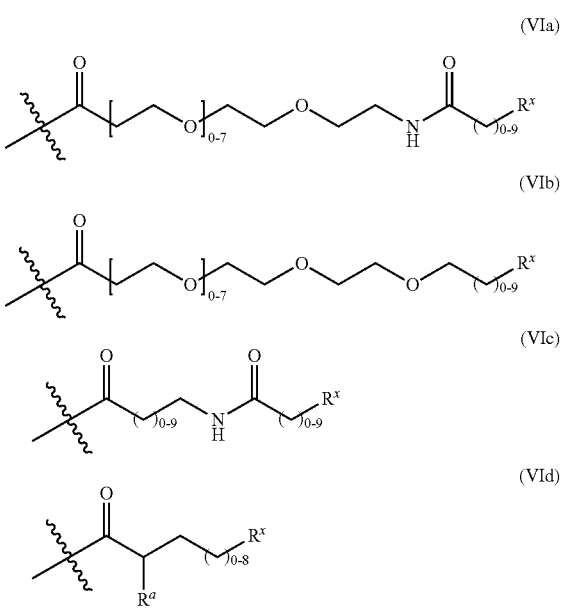

(VIa)

(VIb)

(VIc)

(VId)

or salts thereof, where: $R^a$ is selected from hydrogen, alkyl, sulfonate and methyl sulfonate; $R^x$ is a moiety including a functional group capable of covalently linking the ADC linker to a CD2 binding molecule; and $^f$ represents the point of attachment of the ADC linker to a cytotoxic and/or cytostatic agent.

Specific exemplary embodiments of ADC linkers according to structural formula (VIa)-(VId) that can be included in the ADCs include the ADC linkers illustrated below (as illustrated, the ADC linkers include a group suitable for covalently linking the ADC linker to a CD2 binding molecule, and $^f$ represents the point of attachment to a cytotoxic and/or cytostatic agent):

(VIa)

-continued (VIa.1)

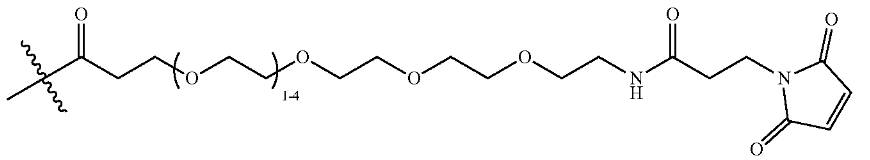

(VIc.1)

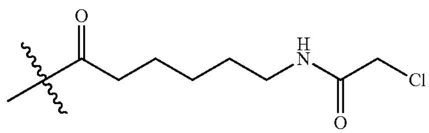

(VIc.2)

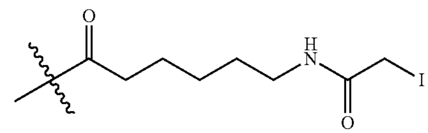

(VId.1)

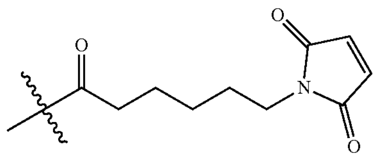

(VId.2)

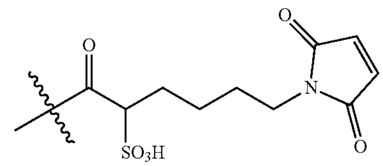

(VId.3)

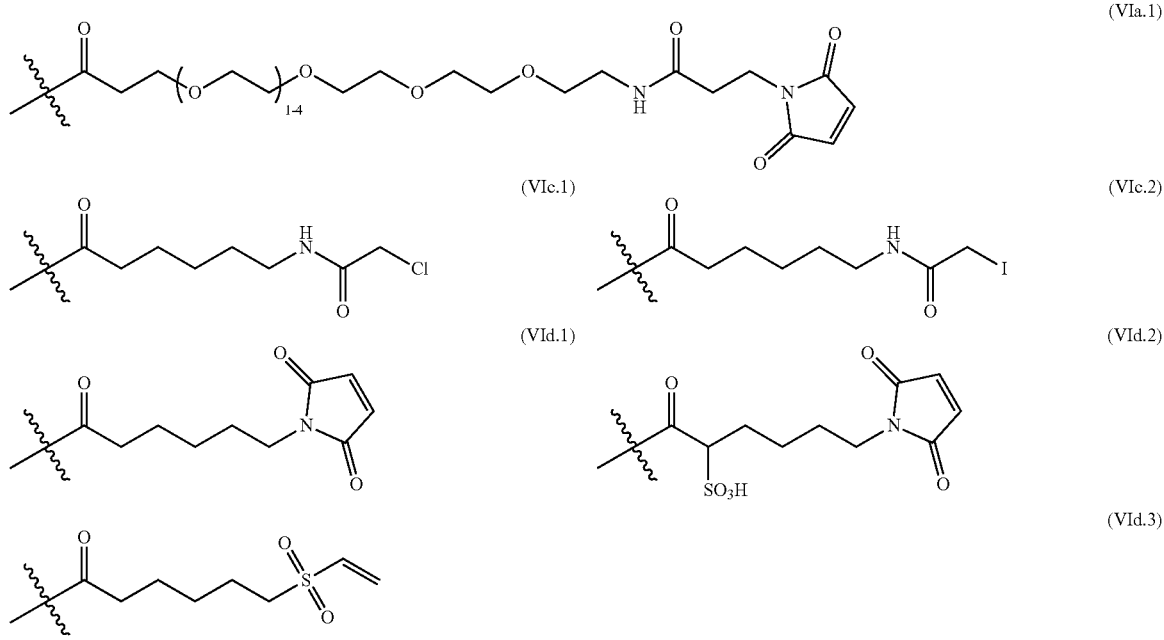
7.13.2.3. Groups Used to Attach Linkers to CD2 Binding Molecules

A variety of groups can be used to attach ADC linker-drug synthons to CD2 binding molecules to yield ADCs. Attachment groups can be electrophilic in nature and include: maleimide groups, activated disulfides, active esters such as NHS esters and HOBt esters, haloformates, acid halides, alkyl and benzyl halides such as haloacetamides. As discussed below, there are also emerging technologies related to "self-stabilizing" maleimides and "bridging disulfides" that can be used in accordance with the disclosure. The specific group used will depend, in part, on the site of attachment to the CD2 binding molecule.

One example of a "self-stabilizing" maleimide group that hydrolyzes spontaneously under CD2 binding molecule conjugation conditions to give an ADC species with improved stability is depicted in the schematic below. See US20130309256 A1; also Lyon et al., Nature Biotech published online, doi:10.1038/nbt.2968.

Normal System:

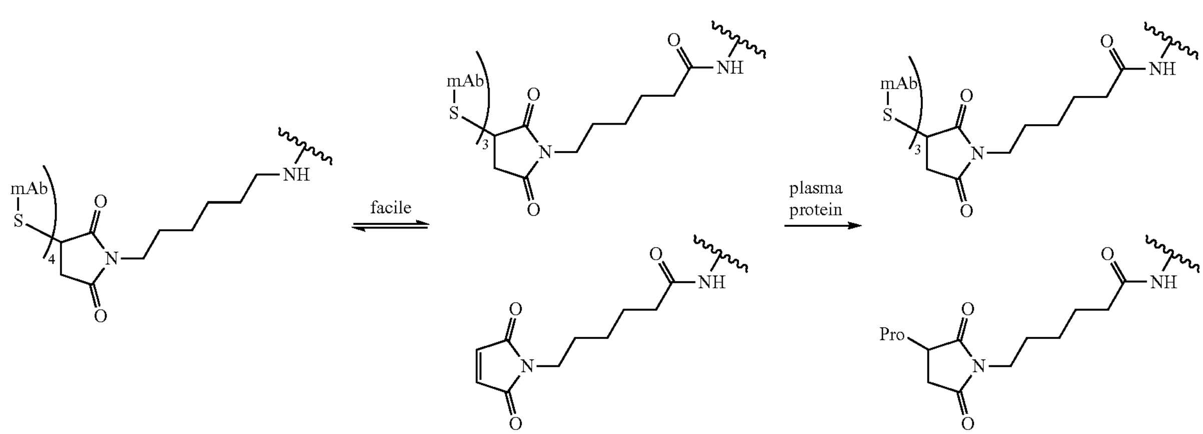

Leads to "DAR loss" over time

SGN MaIDPR (Maleimido Dipropylamino) System:

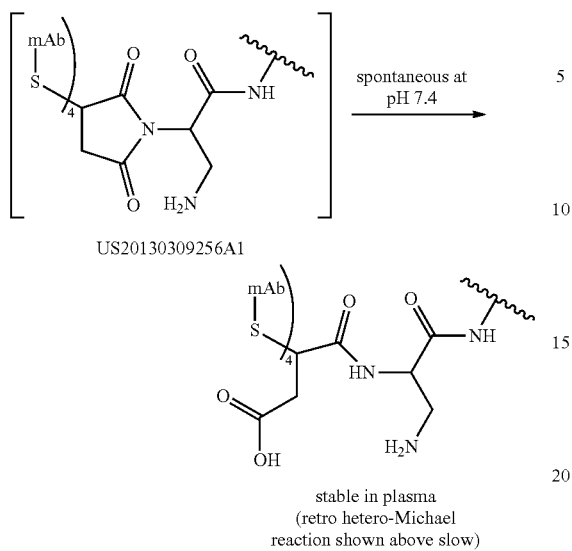

Polytherics has disclosed a method for bridging a pair of sulfhydryl groups derived from reduction of a native hinge disulfide bond. See, Badescu et al., 2014, Bioconjugate Chem. 25:1124-1136. The reaction is depicted in the schematic below. An advantage of this methodology is the ability to synthesize enriched DAR4 ADCs by full reduction of IgGs (to give 4 pairs of sulfhydryls) followed by reaction with 4 equivalents of the alkylating agent. ADCs containing "bridged disulfides" have increased stability.

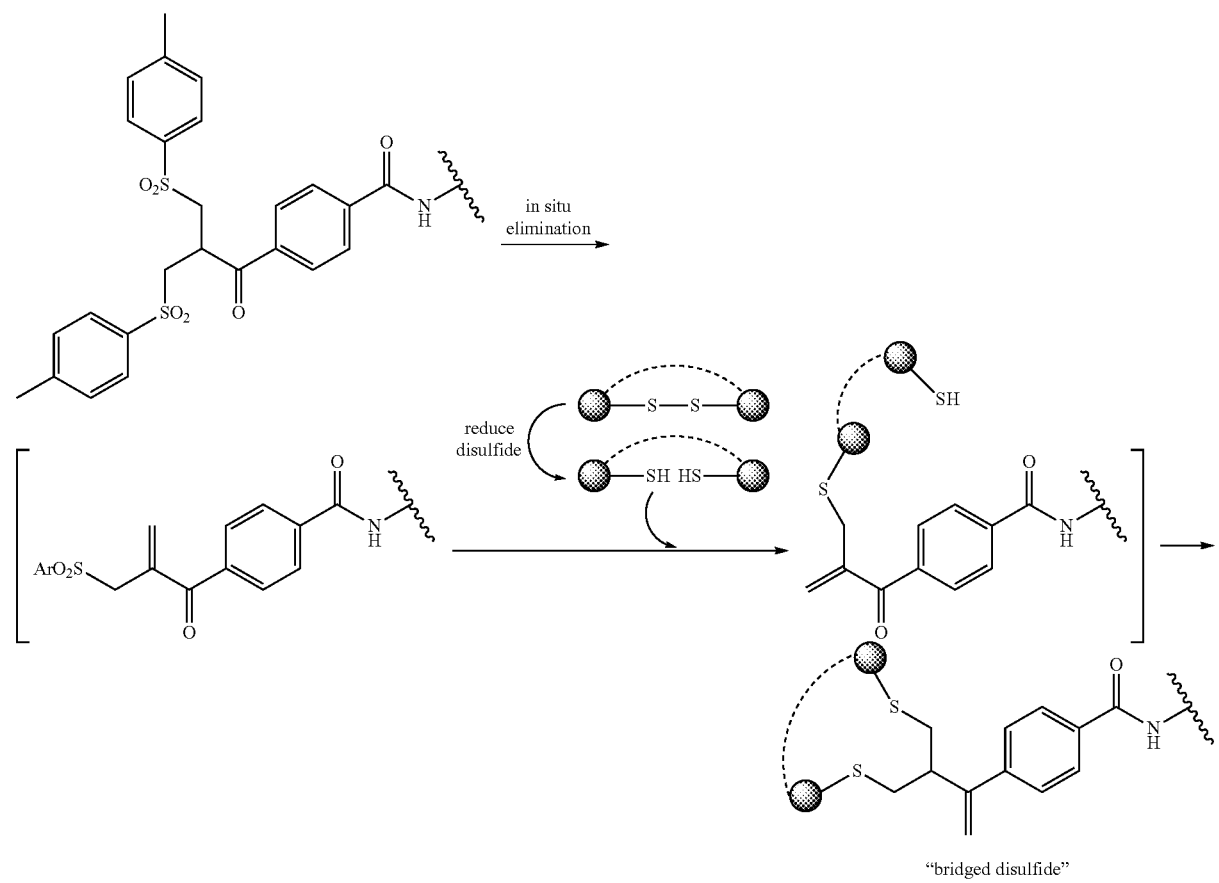

Similarly, as depicted below, a maleimide derivative (1, below) that is capable of bridging a pair of sulfhydryl groups has been developed. See WO2013/085925.

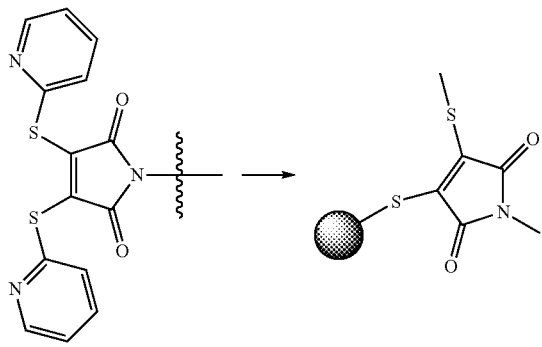

7.13.2.4. ADC Linker Selection Considerations

As is known by skilled artisans, the ADC linker selected for a particular ADC can be influenced by a variety of factors, including but not limited to, the site of attachment to the CD2 binding molecule (e.g., lys, cys or other amino acid residues), structural constraints of the drug pharmacophore and the lipophilicity of the drug. The specific ADC linker selected for an ADC should seek to balance these different factors for the specific CD2 binding molecule/drug combination. For a review of the factors that are influenced by choice of ADC linkers in ADCs, see Nolting, Chapter 5 "Linker Technology in Antibody-Drug Conjugates," In: Antibody-Drug Conjugates: Methods in Molecular Biology, vol. 1045, pp. 71-100, Laurent Ducry (Ed.), Springer Science & Business Medica, LLC, 2013.

For example, ADCs have been observed to effect killing of bystander antigen-negative cells present in the vicinity of the antigen-positive tumor cells. The mechanism of bystander cell killing by ADCs has indicated that metabolic products formed during intracellular processing of the ADCs can play a role. Neutral cytotoxic metabolites generated by metabolism of the ADCs in antigen-positive cells appear to play a role in bystander cell killing while charged metabolites can be prevented from diffusing across the membrane into the medium and therefore cannot affect bystander killing. In certain embodiments, the ADC linker is selected to attenuate the bystander killing effect caused by cellular metabolites of the ADC. In certain embodiments, the ADC linker is selected to increase the bystander killing effect.

The properties of the ADC linker can also impact aggregation of the ADC under conditions of use and/or storage. Typically, ADCs reported in the literature contain no more than 3-4 drug molecules per antibody molecule (see, e.g., Chari, 2008, Acc Chem Res 41:98-107). Attempts to obtain higher drug-to-antibody ratios ("DAR") often failed, particularly if both the drug and the ADC linker were hydrophobic, due to aggregation of the ADC (King et al., 2002, J Med Chem 45:4336-4343; Hollander et al., 2008, Bioconjugate Chem 19:358-361; Burke et al., 2009 Bioconjugate Chem 20:1242-1250). In many instances, DARs higher than 3-4 could be beneficial as a means of increasing potency. In instances where the cytotoxic and/or cytostatic agent is hydrophobic in nature, it can be desirable to select ADC linkers that are relatively hydrophilic as a means of reducing ADC aggregation, especially in instances where DARS greater than 3-4 are desired. Thus, in certain embodiments, the ADC linker incorporates chemical moieties that reduce aggregation of the ADCs during storage and/or use. An ADC linker can incorporate polar or hydrophilic groups such as charged groups or groups that become charged under physiological pH to reduce the aggregation of the ADCs. For example, an ADC linker can incorporate charged groups such as salts or groups that deprotonate, e.g., carboxylates, or protonate, e.g., amines, at physiological pH.

Exemplary polyvalent ADC linkers that have been reported to yield DARs as high as 20 that can be used to link numerous cytotoxic and/or cytostatic agents to a CD2 binding molecule are described in WO 2009/073445; WO 2010/068795; WO 2010/138719; WO 2011/120053; WO 2011/171020; WO 2013/096901; WO 2014/008375; WO 2014/093379; WO 2014/093394; WO 2014/093640.

In particular embodiments, the aggregation of the ADCs during storage or use is less than about 10% as determined by size-exclusion chromatography (SEC). In particular embodiments, the aggregation of the ADCs during storage or use is less than 10%, such as less than about 5%, less than about 4%, less than about 3%, less than about 2%, less than about 1%, less than about 0.5%, less than about 0.1%, or even lower, as determined by size-exclusion chromatography (SEC).

7.13.3. Methods of Making ADCs

The ADCs can be synthesized using chemistries that are well-known. The chemistries selected will depend upon, among other things, the identity of the cytotoxic and/or cytostatic agent(s), the ADC linker and the groups used to attach ADC linker to the CD2 binding molecule. Generally, ADCs according to formula (I) can be prepared according to the following scheme:

D-L-R$^x$+Ab-R$^y$→[D-L-XY]$_n$-Ab  (I)

where D, L, Ab, XY and n are as previously defined, and R$^x$ and R$^y$ represent complementary groups capable of forming a covalent linkages with one another, as discussed above.

The identities of groups R$^x$ and R$^y$ will depend upon the chemistry used to link synthon D-L-R$^x$ to the CD2 binding molecule. Generally, the chemistry used should not alter the integrity of the CD2 binding molecule, for example its ability to bind its target. In some cases, the binding properties of the conjugated antibody will closely resemble those of the unconjugated CD2 binding molecule. A variety of chemistries and techniques for conjugating molecules to biological molecules and in particular to immunoglobulins, whose components are typically building blocks of the CD2 binding molecules of the disclosure, are well-known. See, e.g., Amon et al., "Monoclonal Antibodies For Immunotargeting Of Drugs In Cancer Therapy," in: Monoclonal Antibodies And Cancer Therapy, Reisfeld et al. Eds., Alan R. Liss, Inc., 1985; Hellstrom et al., "Antibodies For Drug Delivery," in: Controlled Drug Delivery, Robinson et al. Eds., Marcel Dekker, Inc., 2nd Ed. 1987; Thorpe, "Antibody Carriers Of Cytotoxic Agents In Cancer Therapy: A Review," in: Monoclonal Antibodies '84: Biological And Clinical Applications, Pinchera et al., Eds., 1985; "Analysis, Results, and Future Prospective of the Therapeutic Use of Radiolabeled Antibody In Cancer Therapy," in: Monoclonal Antibodies For Cancer Detection And Therapy, Baldwin et al., Eds., Academic Press, 1985; Thorpe et al., 1982, Immunol. Rev. 62:119-58; PCT publication WO 89/12624. Any of these chemistries can be used to link the synthons to a CD2 binding molecule.

A number of functional groups R$^x$ and chemistries useful for linking synthons to accessible lysine residues are known, and include by way of example and not limitation NHS-esters and isothiocyanates.

A number of functional groups $R^x$ and chemistries useful for linking synthons to accessible free sulfhydryl groups of cysteine residues are known, and include by way of example and not limitation haloacetyls and maleimides.

However, conjugation chemistries are not limited to available side chain groups. Side chains such as amines can be converted to other useful groups, such as hydroxyls, by linking an appropriate small molecule to the amine. This strategy can be used to increase the number of available linking sites on the antibody by conjugating multifunctional small molecules to side chains of accessible amino acid residues of the CD2 binding molecule. Functional groups $R^x$ suitable for covalently linking the synthons to these "converted" functional groups are then included in the synthons.

The CD2 binding molecule can also be engineered to include amino acid residues for conjugation. An approach for engineering BBMs to include non-genetically encoded amino acid residues useful for conjugating drugs in the context of ADCs is described by Axup et al., 2012, Proc Natl Acad Sci USA. 109(40):16101-16106, as are chemistries and functional group useful for linking synthons to the non-encoded amino acids.

Typically, the synthons are linked to the side chains of amino acid residues of the CD2 binding molecule, including, for example, the primary amino group of accessible lysine residues or the sulfhydryl group of accessible cysteine residues. Free sulfhydryl groups can be obtained by reducing interchain disulfide bonds.

For linkages where $R^y$ is a sulfhydryl group (for example, when $R^x$ is a maleimide), the CD2 binding molecule is generally first fully or partially reduced to disrupt interchain disulfide bridges between cysteine residues.

Cysteine residues that do not participate in disulfide bridges can engineered into a CD2 binding molecule by modification of one or more codons. Reducing these unpaired cysteines yields a sulfhydryl group suitable for conjugation. In some embodiments, CD2 binding molecules are engineered to introduce one or more cysteine residues as sites for conjugation to a drug moiety (see, Junutula, et al, 2008, Nat Biotechnol, 26:925-932).

Sites for cysteine substitution can be selected in a constant region to provide stable and homogeneous conjugates. A CD2 binding molecule can have, for example, two or more cysteine substitutions, and these substitutions can be used in combination with other modification and conjugation methods as described herein. Methods for inserting cysteine at specific locations of an antibody are known, see, e.g., Lyons et al., 1990, Protein Eng., 3:703-708, WO 2011/005481, WO2014/124316, WO 2015/138615. In certain embodiments, a CD2 binding molecule comprises a substitution of one or more amino acids with cysteine on a constant region selected from positions 117, 119, 121, 124, 139, 152, 153, 155, 157, 164, 169, 171, 174, 189, 205, 207, 246, 258, 269, 274, 286, 288, 290, 292, 293, 320, 322, 326, 333, 334, 335, 337, 344, 355, 360, 375, 382, 390, 392, 398, 400 and 422 of a heavy chain, where the positions are numbered according to the EU system. In some embodiments, a CD2 binding molecule comprises a substitution of one or more amino acids with cysteine on a constant region selected from positions 107, 108, 109, 114, 129, 142, 143, 145, 152, 154, 156, 159, 161, 165, 168, 169, 170, 182, 183, 197, 199, and 203 of a light chain, where the positions are numbered according to the EU system, and where the light chain is a human kappa light chain. In certain embodiments a CD2 binding molecule comprises a combination of substitution of two or more amino acids with cysteine on a constant region, where the combinations comprise substitutions at positions 375 of a heavy chain, position 152 of a heavy chain, position 360 of a heavy chain, or position 107 of a light chain and where the positions are numbered according to the EU system. In certain embodiments a CD2 binding molecule comprises a substitution of one amino acid with cysteine on a constant region where the substitution is position 375 of a heavy chain, position 152 of a heavy chain, position 360 of a heavy chain, position 107 of a light chain, position 165 of a light chain or position 159 of a light chain and where the positions are numbered according to the EU system, and where the light chain is a kappa chain.

In particular embodiments, a CD2 binding molecule comprises a combination of substitution of two amino acids with cysteine on a constant region, where the CD2 binding molecule comprises cysteines at positions 152 and 375 of a heavy chain, where the positions are numbered according to the EU system.

In other particular embodiments, a CD2 binding molecule comprises a substitution of one amino acid with cysteine at position 360 of a heavy chain, where the positions are numbered according to the EU system.

In other particular embodiments, a CD2 binding molecule comprises a substitution of one amino acid with cysteine at position 107 of a light chain, where the positions are numbered according to the EU system, and where the light chain is a kappa chain.

Other positions for incorporating engineered cysteines can include, by way of example and not limitation, positions S112C, S113C, A114C, S115C, A1760, 5180C, S252C, V286C, V292C, S357C, A359C, S398C, S428C (Kabat numbering) on the human IgG, heavy chain and positions V110C, S114C, S121C, S127C, S168C, V205C (Kabat numbering) on the human Ig kappa light chain (see, e.g., U.S. Pat. Nos. 7,521,541, 7,855,275 and 8,455,622).

CD2 binding molecules useful in ADCs disclosed herein can additionally or alternatively be modified to introduce one or more other reactive amino acids (other than cysteine), including Pcl, pyrrolysine, peptide tags (such as S6, A1 and ybbR tags), and non-natural amino acids, in place of at least one amino acid of the native sequence, thus providing a reactive site on the CD2 binding molecule for conjugation to a drug moiety. For example, CD2 binding molecules can be modified to incorporate Pcl or pyrrolysine (W. Ou et al., 2011, PNAS, 108(26):10437-10442; WO2014124258) or unnatural amino acids (Axup, et al., 2012, PNAS, 109: 16101-16106; for review, see C. C. Liu and P. G. Schultz, 2010, Annu Rev Biochem 79:413-444; Kim, et al., 2013, Curr Opin Chem Biol. 17:412-419) as sites for conjugation to a drug. Similarly, peptide tags for enzymatic conjugation methods can be introduced into a CD2 binding molecule (see, Strop et al. 2013, Chem Biol. 20(2):161-7; Rabuka, 2010, Curr Opin Chem Biol. 14(6):790-6; Rabuka, et al., 2012, Nat Protoc. 7(6):1052-67). One other example is the use of 4'-phosphopantetheinyl transferases (PPTase) for the conjugation of Coenzyme A analogs (WO2013184514). Such modified or engineered MBMs can be conjugated with payloads or linker-payload combinations according to known methods.

As will appreciated by a skilled artisan, the number of agents (e.g., cytotoxic and/or cytostatic agents) linked to a CD2 binding molecule can vary, such that a collection of ADCs can be heterogeneous in nature, where some CD2 binding molecules contain one linked agent, some two, some three, etc. (and some none). The degree of heterogeneity will depend upon, among other things, the chemistries used for linking the cytotoxic and/or cytostatic agents. For example, where the CD2 binding molecules are reduced to yield sulfhydryl groups for attachment, heterogeneous mixtures of CD2 binding molecules having zero, 2, 4, 6 or 8 linked agents per molecule are often produced. Furthermore, by limiting the molar ratio of attachment compound, CD2 binding molecules having zero, 1, 2, 3, 4, 5, 6, 7 or 8 linked agents per molecule are often produced. Thus, it will be understood that depending upon context, stated drug CD2 binding molecule ratios (DTRs) can be averages for a collection of CD2 binding molecules. For example, "DTR4" can refer to an ADC preparation that has not been subjected to purification to isolate specific DTR peaks and can comprise a heterogeneous mixture of ADC molecules having different numbers of cytostatic and/or cytotoxic agents attached per CD2 binding molecule (e.g., 0, 2, 4, 6, 8 agents per CD2 binding molecule), but has an average drug-to-CD2 binding molecule ratio of 4. Similarly, in some embodiments, "DTR2" refers to a heterogeneous ADC preparation in which the average drug-to-CD2 binding molecule ratio is 2.

When enriched preparations are desired, CD2 binding molecules having defined numbers of linked cytotoxic and/or cytostatic agents can be obtained via purification of heterogeneous mixtures, for example, via column chromatography, e.g., hydrophobic interaction chromatography.

Purity can be assessed by a variety of known methods. As a specific example, an ADC preparation can be analyzed via HPLC or other chromatography and the purity assessed by analyzing areas under the curves of the resultant peaks.

7.14. CD2 Binding Molecules Conjugated to Detectable Agents

CD2 binding molecules of the disclosure can be conjugated to a diagnostic or detectable agent. Such molecules can be useful for monitoring or prognosing the onset, development, progression and/or severity of a disease or disorder as part of a clinical testing procedure, such as determining the efficacy of a particular therapy. Such diagnosis and detection can accomplished by coupling the CD2 binding molecules to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, umbelliferone, fluorescein, fluorescein isothiocynate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; radioactive materials, such as, but not limited to, iodine ($^{131}$I, $^{125}$I, $^{123}$I, and $^{121}$I), carbon ($^{14}$C), sulfur ($^{35}$S), tritium ($^{3}$H), indium ($^{115}$In, $^{113}$In, $^{112}$In, and $^{111}$In), technetium ($^{99}$Tc), thallium ($^{201}$Ti), gallium ($^{68}$Ga, $^{67}$Ga), palladium ($^{103}$Pd), molybdenum ($^{99}$Mo), xenon ($^{133}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, $^{97}$Ru, $^{68}$Ge, $^{57}$Co, $^{65}$Zn, $^{85}$Sr, $^{32}$P, $^{153}$Gd, $^{169}$Yb, $^{51}$Cr, $^{54}$Mn, $^{75}$Se, $^{113}$Sn, and $^{117}$Tin; and positron emitting metals using various positron emission tomographies, and nonradioactive paramagnetic metal ions.

7.15. CD2 Binding Molecules Attached to Solid Supports

The CD2 binding molecules can also be attached to solid supports, which are particularly useful for immunoassays or purification of the target antigen(s). Such solid supports include, but are not limited to, glass, cellulose, polyacrylamide, nylon, polystyrene, polyvinyl chloride or polypropylene.

7.16. Pharmaceutical Compositions

The CD2 binding molecules of the disclosure (as well as their conjugates; references to CD2 binding molecules in this disclosure also refers to conjugates comprising the CD2 binding molecules, such as ADCs, unless the context dictates otherwise) can be formulated as pharmaceutical compositions comprising the CD2 binding molecules, for example containing one or more pharmaceutically acceptable excipients or carriers. To prepare pharmaceutical or sterile compositions comprising the CD2 binding molecules of the present disclosure a CD2 binding molecule preparation can be combined with one or more pharmaceutically acceptable excipient or carrier.

For example, formulations of CD2 binding molecules can be prepared by mixing CD2 binding molecules with physiologically acceptable carriers, excipients, or stabilizers in the form of, e.g., lyophilized powders, slurries, aqueous solutions, lotions, or suspensions (see, e.g., Hardman et al., 2001, Goodman and Gilman's The Pharmacological Basis of Therapeutics, McGraw-Hill, New York, N.Y.; Gennaro, 2000, Remington: The Science and Practice of Pharmacy, Lippincott, Williams, and Wilkins, New York, N.Y.; Avis, et al. (eds.), 1993, Pharmaceutical Dosage Forms: General Medications, Marcel Dekker, NY; Lieberman, et al. (eds.), 1990, Pharmaceutical Dosage Forms: Tablets, Marcel Dekker, NY; Lieberman, et al. (eds.), 1990, Pharmaceutical Dosage Forms: Disperse Systems, Marcel Dekker, NY; Weiner and Kotkoskie, 2000, Excipient Toxicity and Safety, Marcel Dekker, Inc., New York, N.Y.).

Selecting an administration regimen for a CD2 binding molecule depends on several factors, including the serum or tissue turnover rate of the CD2 binding molecule, the level of symptoms, the immunogenicity of the CD2 binding molecule, and the accessibility of the target cells. In certain embodiments, an administration regimen maximizes the amount of CD2 binding molecule delivered to the subject consistent with an acceptable level of side effects. Accordingly, the amount of CD2 binding molecule delivered depends in part on the particular CD2 binding molecule and the severity of the condition being treated. Guidance in selecting appropriate doses of antibodies and small molecules are available (see, e.g., Wawrzynczak, 1996, Antibody Therapy, Bios Scientific Pub. Ltd, Oxfordshire, UK; Kresina (ed.), 1991, Monoclonal Antibodies, Cytokines and Arthritis, Marcel Dekker, New York, N.Y.; Bach (ed.), 1993, Monoclonal Antibodies and Peptide Therapy in Autoimmune Diseases, Marcel Dekker, New York, N.Y.; Baert et al., 2003, New Engl. J. Med. 348:601-608; Milgrom et al., 1999, New Engl. J. Med. 341:1966-1973; Slamon et al., 2001, New Engl. J. Med. 344:783-792; Beniaminovitz et al., 2000, New Engl. J. Med. 342:613-619; Ghosh et al., 2003, New Engl. J. Med. 348:24-32; Lipsky et al., 2000, New Engl. J. Med. 343:1594-1602).

Determination of the appropriate dose is made by the clinician, e.g., using parameters or factors known or suspected in the art to affect treatment or predicted to affect treatment. Generally, the dose begins with an amount somewhat less than the optimum dose and it is increased by small increments thereafter until the desired or optimum effect is achieved relative to any negative side effects. Important diagnostic measures include those of symptoms of, e.g., the inflammation or level of inflammatory cytokines produced.

Actual dosage levels of the CD2 binding molecules in the pharmaceutical compositions of the present disclosure can be varied so as to obtain an amount of the CD2 binding molecule which is effective to achieve the desired therapeutic response for a particular subject, composition, and mode of administration, without being toxic to the subject. The selected dosage level will depend upon a variety of pharmacokinetic factors including the activity of the particular CD2 binding molecule, the route of administration, the time of administration, the rate of excretion of the particular CD2 binding molecule being employed, the duration of the treatment, other agents (e.g., active agents such as therapeutic drugs or compounds and/or inert materials used as carriers) in combination with the particular CD2 binding molecule employed, the age, sex, weight, condition, general health and prior medical history of the subject being treated, and like factors known in the medical arts.

Compositions comprising the CD2 binding molecules can be provided by continuous infusion, or by doses at intervals of, e.g., one day, one week, or 1-7 times per week. Doses can be provided intravenously, subcutaneously, topically, orally, nasally, rectally, intramuscular, intracerebrally, or by inhalation. A specific dose protocol is one involving the maximal dose or dose frequency that avoids significant undesirable side effects.

An effective amount for a particular subject can vary depending on factors such as the condition being treated, the overall health of the subject, the method route and dose of administration and the severity of side effects (see, e.g., Maynard, et al. (1996) A Handbook of SOPs for Good Clinical Practice, Interpharm Press, Boca Raton, Fla.; Dent (2001) Good Laboratory and Good Clinical Practice, Urch Publ., London, UK).

The route of administration can be by, e.g., topical or cutaneous application, injection or infusion by intravenous, intraperitoneal, intracerebral, intramuscular, intraocular, intraarterial, intracerebrospinal, intralesional, or by sustained release systems or an implant (see, e.g., Sidman et al., 1983, Biopolymers 22:547-556; Langer et al., 1981, J. Biomed. Mater. Res. 15:167-277; Langer, 1982, Chem. Tech. 12:98-105; Epstein et al., 1985, Proc. Natl. Acad. Sci. USA 82:3688-3692; Hwang et al., 1980, Proc. Natl. Acad. Sci. USA 77:4030-4034; U.S. Pat. Nos. 6,350,466 and 6,316,024). Where necessary, the composition can also include a solubilizing agent and a local anesthetic such as lidocaine to ease pain at the site of the injection. In addition, pulmonary administration can also be employed, e.g., by use of an inhaler or nebulizer, and formulation with an aerosolizing agent. See, e.g., U.S. Pat. Nos. 6,019,968, 5,985,320, 5,985,309, 5,934,272, 5,874,064, 5,855,913, 5,290,540, and 4,880,078; and PCT Publication Nos. WO 92/19244, WO 97/32572, WO 97/44013, WO 98/31346, and WO 99/66903.

A composition of the present disclosure can also be administered via one or more routes of administration using one or more of a variety of known methods. As will be appreciated by a skilled artisan, the route and/or mode of administration will vary depending upon the desired results. Selected routes of administration for CD2 binding molecules include intravenous, intramuscular, intradermal, intraperitoneal, subcutaneous, spinal or other general routes of administration, for example by injection or infusion. General administration can represent modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion. Alternatively, a composition of the disclosure can be administered via a non-general route, such as a topical, epidermal or mucosal route of administration, for example, intranasally, orally, vaginally, rectally, sublingually or topically. In one embodiment, the CD2 binding molecule is administered by infusion. In another embodiment, the CD2 binding molecule is administered subcutaneously.

If the CD2 binding molecules are administered in a controlled release or sustained release system, a pump can be used to achieve controlled or sustained release (see Langer, supra; Sefton, 1987, CRC Crit. Ref Biomed. Eng. 14:20; Buchwald et al., 1980, Surgery 88:507; Saudek et al., 1989, N. Engl. J. Med. 321:574). Polymeric materials can be used to achieve controlled or sustained release of the therapies of the disclosure (see, e.g., Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, 1983, J., Macromol. Sci. Rev. Macromol. Chem. 23:61; see also Levy et al., 1985, Science 228:190; During et al., 1989, Ann. Neurol. 25:351; Howard et al., 1989, J. Neurosurg. 71:105); U.S. Pat. Nos. 5,679,377; 5,916,597; 5,912,015; 5,989,463; 5,128,326; PCT Publication No. WO 99/15154; and PCT Publication No. WO 99/20253. Examples of polymers used in sustained release formulations include, but are not limited to, poly(2-hydroxy ethyl methacrylate), poly(methyl methacrylate), poly(acrylic acid), poly(ethylene-co-vinyl acetate), poly(methacrylic acid), polyglycolides (PLG), polyanhydrides, poly(N-vinyl pyrrolidone), poly(vinyl alcohol), polyacrylamide, poly(ethylene glycol), polylactides (PLA), poly(lactide-co-glycolides) (PLGA), and polyorthoesters. In one embodiment, the polymer used in a sustained release formulation is inert, free of leachable impurities, stable on storage, sterile, and biodegradable. A controlled or sustained release system can be placed in proximity of the prophylactic or therapeutic target, thus requiring only a fraction of the systemic dose (see, e.g., Goodson, in Medical Applications of Controlled Release, supra, vol. 2, pp. 115-138 (1984)).

Controlled release systems are discussed in the review by Langer (1990, Science 249:1527-1533). Any technique known to one of skill in the art can be used to produce sustained release formulations comprising one or more CD2 binding molecules of the disclosure. See, e.g., U.S. Pat. No. 4,526,938, PCT publication WO 91/05548, PCT publication WO 96/20698, Ning et al., 1996, Radiotherapy & Oncology 39:179-189, Song et al., 1995, PDA Journal of Pharmaceutical Science & Technology 50:372-397, Cleek et al., 1997, Pro. Intl Symp. Control. Rel. Bioact. Mater. 24:853-854, and Lam et al., 1997, Proc. Intl Symp. Control Rel. Bioact. Mater. 24:759-760.

If the CD2 binding molecules are administered topically, they can be formulated in the form of an ointment, cream, transdermal patch, lotion, gel, shampoo, spray, aerosol, solution, emulsion, or other form well-known to one of skill in the art. See, e.g., Remington's Pharmaceutical Sciences and Introduction to Pharmaceutical Dosage Forms, 19th ed., Mack Pub. Co., Easton, Pa. (1995). For non-sprayable topical dosage forms, viscous to semi-solid or solid forms comprising a carrier or one or more excipients compatible with topical application and having a dynamic viscosity, in some instances, greater than water are typically employed. Suitable formulations include, without limitation, solutions, suspensions, emulsions, creams, ointments, powders, liniments, salves, and the like, which are, if desired, sterilized or mixed with auxiliary agents (e.g., preservatives, stabilizers, wetting agents, buffers, or salts) for influencing various properties, such as, for example, osmotic pressure. Other suitable topical dosage forms include sprayable aerosol preparations where the active ingredient, in some instances, in combination with a solid or liquid inert carrier, is packaged in a mixture with a pressurized volatile (e.g., a gaseous propellant, such as freon) or in a squeeze bottle. Moisturizers or humectants can also be added to pharmaceutical compositions and dosage forms if desired. Examples of such additional ingredients are well-known.

If the compositions comprising the CD2 binding molecules are administered intranasally, the CD2 binding molecules can be formulated in an aerosol form, spray, mist or in the form of drops. In particular, prophylactic or therapeutic agents for use according to the present disclosure can be conveniently delivered in the form of an aerosol spray presentation from pressurized packs or a nebulizer, with the use of a suitable propellant (e.g., dichlorodifluoromethane, trichlorofluoromethane, dichlorotetrafluoroethane, carbon dioxide or other suitable gas). In the case of a pressurized aerosol the dosage unit can be determined by providing a valve to deliver a metered amount. Capsules and cartridges (composed of, e.g., gelatin) for use in an inhaler or insufflator can be formulated containing a powder mix of the CD2 binding molecule and a suitable powder base such as lactose or starch.

The CD2 binding molecules of the disclosure can be administered in combination therapy regimens, as described in Section 7.18, infra.

In certain embodiments, the CD2 binding molecules can be formulated to ensure proper distribution in vivo. For example, the blood-brain barrier (BBB) excludes many highly hydrophilic compounds. To ensure that the therapeutic compounds of the disclosure cross the BBB (if desired), they can be formulated, for example, in liposomes. For methods of manufacturing liposomes, see, e.g., U.S. Pat. Nos. 4,522,811; 5,374,548; and 5,399,331. The liposomes can comprise one or more moieties which are selectively transported into specific cells or organs, thus enhance targeted drug delivery (see, e.g., Ranade, 1989, J. Clin. Pharmacol. 29:685). Exemplary targeting moieties include folate or biotin (see, e.g., U.S. Pat. No. 5,416,016 to Low et al.); mannosides (Umezawa et al., 1988, Biochem. Biophys. Res. Commun. 153:1038); antibodies (Bloeman et al., 1995, FEBS Lett. 357:140; Owais et al., 1995, Antimicrob. Agents Chemother. 39:180); surfactant protein A receptor (Briscoe et al., 1995, Am. J. Physiol. 1233:134); p 120 (Schreier et al., 1994, J. Biol. Chem. 269:9090); see also Keinanen and Laukkanen, 1994, FEBS Lett. 346:123; Killion and Fidler, 1994, Immunomethods 4:273.

When used in combination therapy, e.g., as described in Section 7.18, infra, a CD2 binding molecule and one or more additional agents can be administered to a subject in the same pharmaceutical composition. Alternatively, the CD2 binding molecule and the additional agent(s) of the combination therapies can be administered concurrently to a subject in separate pharmaceutical compositions.

The therapeutic methods described herein can further comprise carrying a "companion diagnostic" test whereby a sample from a subject who is a candidate for therapy with a CD2 binding molecule is tested for the expression of CD19. The companion diagnostic test can be performed prior to initiating therapy with a CD2 binding molecule and/or during a therapeutic regimen with a CD2 binding molecule to monitor the subject's continued suitability for CD2 binding molecule therapy. The agent used in the companion diagnostic can be the CD2 binding molecule itself or another diagnostic agent, for example a labeled monospecific antibody against CD19 or a nucleic acid probe to detect CD19 RNA. The sample that can be tested in a companion diagnostic assay can be any sample in which the cells targeted by the CD2 binding molecule can be present, from example a tumor (e.g., a solid tumor) biopsy, lymph, stool, urine, blood or any other bodily fluid that might contain circulating tumor cells.

7.17. Therapeutic Indications

The CD2 binding molecules of the disclosure can be used in the treatment of immune (e.g., autoimmune) and inflammatory disease as well as proliferative diseases such as cancer.

The Ig fusion proteins of the disclosure are particularly useful for the treatment of immune related disorders, for example an immune or inflammatory disorder. Examples of immune and inflammatory disorders which can benefit from treatment with the Ig fusion proteins of the disclosure include autoimmune disorders such as rheumatoid arthritis, psoriatic arthritis, ankylosing spondylitis, Reiter's Syndrome, systemic lupus erythematosus, dermatomyositis, Sjogren's syndrome, lupus erythematosus, multiple sclerosis, myasthenia gravis, psoriasis, and transplant rejection, and inflammatory disorders such as Crohn's disease, lupus nephritis, ulcerative colitis, asthma, encephilitis, inflammatory bowel disease, chronic obstructive pulmonary disease (COPD), arthritis, and allergic disorders. Autoimmune disorders which can benefit from treatment with Ig fusion proteins of the disclosure can be, for example, autoimmune disorders characterized by infiltration of lymphocytes into dermal or epidermal tissues and/or characterized by increased T cell activation or abnormal antigen presentation.

The multispecific binding proteins of the disclosure are particularly useful to treat cancers, particularly those that express TAAs targeted by such multispecific binding proteins.

The MBMs targeting a TAA can be used in the treatment of any proliferative disorder (e.g., cancer) that expresses a TAA. In particular embodiments, the cancer is HER2+ cancer, acute lymphoblastic leukemia (ALL), acute myeloid leukemia (AML), adrenocortical carcinoma, anal cancer, appendix cancer, astrocytoma, basal cell carcinoma, brain tumor, bile duct cancer, bladder cancer, bone cancer, breast cancer, bronchial tumor, Burkitt Lymphoma, carcinoma of unknown primary origin, cardiac tumor, cervical cancer, chordoma, chronic lymphocytic leukemia (CLL), chronic myelogenous leukemia (CML), chronic myeloproliferative neoplasm, colon cancer, colorectal cancer, craniopharyngioma, cutaneous T-cell lymphoma, ductal carcinoma, embryonal tumor, endometrial cancer, ependymoma, esophageal cancer, esthesioneuroblastoma, fibrous histiocytoma, Ewing sarcoma, eye cancer, germ cell tumor, gallbladder cancer, gastric cancer, gastrointestinal carcinoid tumor, gastrointestinal stromal tumor, gestational trophoblastic disease, glioma, head and neck cancer, hairy cell leukemia, hepatocellular cancer, histiocytosis, Hodgkin lymphoma, hypopharyngeal cancer, intraocular melanoma, islet cell tumor, Kaposi sarcoma, kidney cancer, Langerhans cell histiocytosis, laryngeal cancer, leukemia, lip and oral cavity cancer, liver cancer, lobular carcinoma in situ, lung cancer, lymphoma, macroglobulinemia, malignant fibrous histiocytoma, melanoma, Merkel cell carcinoma, mesothelioma, metastatic squamous neck cancer with occult primary, midline tract carcinoma involving NUT gene, mouth cancer, multiple endocrine neoplasia syndrome, multiple myeloma, mycosis fungoides, myelodysplastic syndrome, myelodysplastic/myeloproliferative neoplasm, nasal cavity and para-nasal sinus cancer, nasopharyngeal cancer, neuroblastoma, non-Hodgkin lymphoma, non-small cell lung cancer, oropharyngeal cancer, osteosarcoma, ovarian cancer, pancreatic cancer, papillomatosis, paraganglioma, parathyroid cancer, penile cancer, pharyngeal cancer, pheochromocytomas, pituitary tumor, pleuropulmonary blastoma, primary central nervous system lymphoma, prostate cancer, rectal cancer, renal cell cancer, renal pelvis and ureter cancer, retinoblastoma, rhabdoid tumor, salivary gland cancer, Sezary syndrome, skin cancer, small cell lung cancer, small intestine cancer, soft tissue sarcoma, spinal cord tumor, stomach cancer, T-cell lymphoma, teratoid tumor, testicular cancer, throat cancer, thymoma and thymic carcinoma, thyroid cancer, urethral cancer, uterine cancer, vaginal cancer, vulvar cancer, or Wilms tumor.

Table 18 below shows exemplary indications that MBMs (e.g., TBMs) targeting particular TAAs can be used against.

TABLE 18

Examples of Tumor-Associated Antigen Indications

| Target | Exemplary Indication(s) |
|---|---|
| ADRB3 | Ewing sarcoma |
| ALK | NSCLC, ALCL, IMT, neuroblastoma |
| B7H3 | melanoma, osteosarcoma, leukemia, breast, prostate, ovarian, pancreatic, colorectal cancers |
| BCMA | multiple myeloma, leukemia (e.g., acute lymphoblastic leukemia ("ALL"), acute myeloid leukemia ("AML"), chronic lymphocytic leukemia ("CLL"), chronic myeloid leukemia ("CML") and hairy cell leukemia ("HCL")); lymphoma (e.g., Hodgkin's lymphoma, non-Hodgkin's lymphoma, including diffuse large B-cell lymphoma ("DLBCL")) |
| Cadherin 17 | gastric, pancreatic, and colorectal adenocarcinomas |
| CAIX | clear-cell renal cell carcinoma, hypoxic solid tumors, head and neck squamous carcinoma |
| CD123 | leukemia (e.g., ALL, CLL, AML, CML, HCL); lymphoma (e.g., Hodgkin's lymphoma, non-Hodgkin's lymphoma, e.g., DLBCL); multiple myeloma. In a preferred embodiment, the indication is AML. |
| CD171 | neuroblastoma, paraganglioma |
| CD179a | B cell malignancies |
| CD19 | leukemia (e.g., ALL, CLL, AML, CML, HCL); lymphoma (e.g., Hodgkin's lymphoma, non-Hodgkin's lymphoma, e.g., DLBCL); multiple myeloma. |
| CD20 | leukemia (e.g., ALL, CLL, AML, CML, HCL); lymphoma (e.g., Hodgkin's lymphoma, non-Hodgkin's lymphoma, e.g., DLBCL); multiple myeloma. |
| CD22 | leukemia (e.g., ALL, CLL, AML, CML, HCL); lymphoma (e.g., Hodgkin's lymphoma, non-Hodgkin's lymphoma, e.g., DLBCL); multiple myeloma; lung cancer |
| CD24 | ovarian, breast, prostate, bladder, renal, non-small cell carcinomas |
| CD30 | anaplastic large cell lymphoma, embryonal carcinoma, Hodgkin Lymphoma |
| CD32b | B cell malignancies, gastric, pancreatic, esophageal, glioblastoma, breast, colorectal |
| CD33 | leukemia (e.g., ALL, CLL, AML, CML, HCL); lymphoma (e.g., Hodgkin's lymphoma, non-Hodgkin's lymphoma, e.g., DLBCL); multiple myeloma. In a preferred embodiment, the indication is AML. |
| CD38 | leukemia (e.g., ALL, CLL, AML, CML, HCL); lymphoma (e.g., Hodgkin's lymphoma, non-Hodgkin's lymphoma, e.g., DLBCL); multiple myeloma |
| CD44v6 | colon cancer, head and neck small cell carcinoma |
| CD97 | B cell malignancies, gastric, pancreatic, esophageal, glioblastoma, breast, colorectal |
| CEA | colorectal carcinoma, gastric carcinoma, pancreatic carcinoma, lung cancer, breast cancer, medullary thyroid carcinoma |
| CLDN6 | ovarian, breast, lung cancer |
| CLL-1 | leukemia (e.g., ALL, CLL, AML, CML, HCL); lymphoma (e.g., Hodgkin's lymphoma, non-Hodgkin's lymphoma, e.g., DLBCL); multiple myeloma. In a preferred embodiment, the indication is AML. |
| CS1 | multiple myeloma |
| EGFR | squamous cell carcinoma of lung, anal cancer, glioblastoma, epithelian tumors of head and neck, colon cancer |
| EGFRvIII | Glioblastoma |
| EPCAM | gastrointestestinal carcinoma, colorectal cancer |
| EphA2 | kaposi's sarcoma, glioblastoma, solid tumors, glioma |
| Ephrin B2 | thyroid cancer, breast cancer, malignant melanoma |
| ERBB2 (Her2/neu) | breast, ovarian, gastric cancers, lung adenocarcinoma, non-small cell lung cancer, uterine cancer, uterine serous endometrial carcinoma, salivary duct carcinoma, |
| FAP | pancreatic cancer, colorectal cancer, metastasis, epithelial cancers, soft tissue sarcomas |
| FCRL5 | multiple myeloma |
| FLT3 | leukemia (e.g., ALL, CLL, AML, CML, HCL); lymphoma (e.g., Hodgkin's lymphoma, non-Hodgkin's lymphoma, e.g., DLBCL); multiple myeloma. In a preferred embodiment, the indication is AML. |
| Folate receptor alpha | ovarian, breast, renal, lung, colorectal, brain cancers |
| Folate receptor beta | ovarian cancer |

TABLE 18-continued

Examples of Tumor-Associated Antigen Indications

| Target | Exemplary Indication(s) |
|---|---|
| Fucosyl GM1 | AML, myeloma |
| GD2 | malignant melanoma, neuroblastoma |
| GD3 | Melanoma |
| GloboH | ovarian, gastric, prostate, lung, breast, and pancreatic cancers |
| gp100 | Melanoma |
| GPNMB | breast cancer, head and neck cancers |
| GPR20 | GIST |
| GPR64 | Ewing sarcoma, prostate, kidney and lung sarcomas |
| GPRC5D | multiple myeloma |
| HAVCR1 | renal cancer |
| HER3 | colon and gastric cancers |
| HMWMAA | melanoma, glioblastoma, breast cancer |
| IGF-I receptor | breast, prostate, lung cancers |
| IL-11Ra | papillary thyroid cancer, osteosarcoma, colorectal adenocarcinoma, lymphocytic leukemia |
| IL-13Ra2 | renal cell carcinoma, prostate cancer, gliomas, head and neck cancer, astrocytoma |
| KIT | myeloid leukemia, kaposi's sarcoma, erythroleukemia, gastrointestinal stromal tumors |
| KLRG2 | breast cancers, lung cancers and ovarian cancers. |
| LewisY | squamous cell lung carcinoma, lung adenocarcinoma, ovarian carcinoma, and colorectal adenocarcinoma |
| LMP2 | prostate cancer, Hodgkin's lymphoma, nasopharyngeal carcinoma |
| LRP6 | breast cancer |
| LY6K | breast, lung, ovarian, and cervical cancer |
| LYPD8 | colorectal and gastric cancers |
| Mesothelin | mesothelioma, pancreatic cancer, ovarian cancer, stomach cancer, lung cancer, endometrial cancer. |
| MUC1 | breast and ovarian cancers, lung, stomach, pancreatic, prostate cancers |
| NCAM | melanoma, Wilms' tumor, small cell lung cancer, neuroblastoma, myeloma, paraganglioma, pancreatic acinar cell carcinoma, myeloid leukemia |
| NY-BR-1 | breast cancer |
| o-acetyl GD2 | neuroblastoma, melanoma |
| OR51E2 | prostate cancer |
| PANX3 | osteosarcoma |
| PLAC1 | hepatocellular carcinoma |
| Polysialic acid | small cell lung cancer |
| PDGFR-beta | myelomonocytic leukemia, chronic myeloid leukemia, acute myelogenous leukemia, acute lymphoblastic leukemia |
| PRSS21 | colon cancer, testicular cancer, ovarian cancer |
| PSCA | prostate cancer, gastric and bladder cancers |
| PSMA | prostate cancer, |
| ROR1 | metastatic cancers, chronic lymphocytic leukemia, solid tumors in lung, breast, ovarian, colon, pancreatic, sarcoma |
| SLC34A2 | bladder cancer |
| SLC39A6 | breast cancer, esophageal cancer |
| SLITRK6 | breast cancer, urothelial cancer, lung cancer |
| SSEA-4 | breast cancer, cancer stem cells, epithelial ovarian carcinoma |
| TACSTD2 | carcinomas, e.g., non-small-cell lung cancer |
| TAG72 | ovarian, breast, colon, lung, pancreatic cancers, gastric cancer |
| TEM1/CD248 | colorectal cancer |
| TEM7R | colorectal cancer |
| Tn | colorectal, breast cancers, cervical, lung, stomach cancers |
| TSHR | thyroid cancer, multiple myeloma |
| Tyrosinase | prostate cancer, melanoma |
| UPK2 | bladder cancer |
| VEGFR2 | ovarian and pancreatic cancers, renal cell carcinoma, colorectal cancer, medullary thyroid carcinoma |

Accordingly, the present disclosure provides methods of treating cancer comprising administering to a subject suffering from cancer a MBM having a TAA ABM (e.g., ABM2 in the case of a BBM or ABM3 in the case of a TBM) that binds to a TAA expressed on that type of cancer. In some embodiments, a MBM that targets a TAA identified in Table 18 can be administered to a subject afflicted with a cancer that Table 18 indicates expressed the TAA. By way of example and not limitation, a MBM that targets EPCAM or folate receptor alpha can be administered to a subject afflicted with colorectal cancer, a MBM that targets BCMA or CD19 can be administered to a subject afflicted with a blood cancer such as multiple myeloma, a MBM that targets PSCA or PCMA can be administered a subject afflicted with prostate cancer, a MBM that targets tyrosinase or GP3 can be administered to a subject afflicted with melanoma, a TBM that targets CD33, CLL-1 or FLT3 can be administered to a subject afflicted with a blood cancer such as acute myeloid leukemia.

7.18. Combination Therapy

A CD2 binding molecule of the disclosure can be used in combination other known agents and therapies. For example, the CD2 binding molecules can be used in treatment regimens in combination with surgery, chemotherapy, antibodies, radiation, peptide vaccines, steroids, cytoxins, proteasome inhibitors, immunomodulatory drugs (e.g., IMiDs), BH3 mimetics, cytokine therapies, stem cell transplant or any combination thereof.

For convenience, an agent that is used in combination with a CD2 binding molecule is referred to herein as an "additional" agent.

Administered "in combination," as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". For example, each therapy can be administered to a subject at the same time or sequentially in any order at different points in time; however, if not administered at the same time, they should be administered sufficiently close in time so as to provide the desired therapeutic effect.

A CD2 binding molecule and one or more additional agents can be administered simultaneously, in the same or in separate compositions, or sequentially. For sequential administration, the CD2 binding molecule can be administered first, and the additional agent can be administered second, or the order of administration can be reversed.

The CD2 binding molecule and the additional agent(s) can be administered to a subject in any appropriate form and by any suitable route. In some embodiments, the routes of administration are the same. In other embodiments the routes of administration are different.

In other embodiments, the delivery of one treatment ends before the delivery of the other treatment begins.

In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The CD2 binding molecules and/or additional agents can be administered during periods of active disorder, or during a period of remission or less active disease. A CD2 binding molecule can be administered before the treatment with the additional agent(s), concurrently with the treatment with the additional agent(s), post-treatment with the additional agent(s), or during remission of the disorder.

When administered in combination, the CD2 binding molecule and/or the additional agent(s) can be administered in an amount or dose that is higher, lower or the same than the amount or dosage of each agent used individually, e.g., as a monotherapy.

The additional agent(s) of the combination therapies of the disclosure can be administered to a subject concurrently. The term "concurrently" is not limited to the administration of therapies (e.g., prophylactic or therapeutic agents) at exactly the same time, but rather it is meant that a pharmaceutical composition comprising a CD2 binding molecule is administered to a subject in a sequence and within a time interval such that the molecules of the disclosure can act together with the additional therapy(ies) to provide an increased benefit than if they were administered otherwise. For example, each therapy can be administered to a subject at the same time or sequentially in any order at different points in time; however, if not administered at the same time, they should be administered sufficiently close in time so as to provide the desired therapeutic or prophylactic effect. Each therapy can be administered to a subject separately, in any appropriate form and by any suitable route.

The CD2 binding molecule and the additional agent(s) can be administered to a subject by the same or different routes of administration.

The CD2 binding molecules and the additional agent(s) can be cyclically administered. Cycling therapy involves the administration of a first therapy (e.g., a first prophylactic or therapeutic agent) for a period of time, followed by the administration of a second therapy (e.g., a second prophylactic or therapeutic agent) for a period of time, optionally, followed by the administration of a third therapy (e.g., prophylactic or therapeutic agent) for a period of time and so forth, and repeating this sequential administration, i.e., the cycle in order to reduce the development of resistance to one of the therapies, to avoid or reduce the side effects of one of the therapies, and/or to improve the efficacy of the therapies.

In certain instances, the one or more additional agents, are other anti-cancer agents, anti-allergic agents, anti-nausea agents (or anti-emetics), pain relievers, cytoprotective agents, and combinations thereof.

In one embodiment, a CD2 binding molecule can be used in combination with an anti-cancer agent (e.g., a chemotherapeutic agent). Exemplary chemotherapeutic agents include an anthracycline (e.g., doxorubicin (e.g., liposomal doxorubicin)), a vinca alkaloid (e.g., vinblastine, vincristine, vindesine, vinorelbine), an alkylating agent (e.g., cyclophosphamide, decarbazine, melphalan, ifosfamide, temozolomide), an immune cell antibody (e.g., alemtuzumab, gemtuzumab, rituximab, tositumomab, obinutuzumab, ofatumumab, daratumumab, elotuzumab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

General chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

Anti-cancer agents of particular interest for combinations with the CD2 binding molecules of the present disclosure include: anthracyclines; alkylating agents; antimetabolites; drugs that inhibit either the calcium dependent phosphatase calcineurin or the p70S6 kinase FK506) or inhibit the p70S6 kinase; mTOR inhibitors; immunomodulators; anthracyclines; vinca alkaloids; proteasome inhibitors; GITR agonists (e.g., GWN323); protein tyrosine phosphatase inhibitors; a CDK4 kinase inhibitor; a BTK inhibitor; a MKN kinase inhibitor; a DGK kinase inhibitor; an oncolytic virus; a BH3 mimetic; and cytokine therapies.

Exemplary alkylating agents include, without limitation, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

Exemplary mTOR inhibitors include, e.g., temsirolimus; ridaforolimus (formally known as deferolimus, (1R,2R,4S)-4-[(2R)-2 [(1R,9S,12S,15R,16E,18R,19R,21R,23S,24E, 26E,28Z,30S,32S,35R)-1,18-dihydroxy-19,30-dimethoxy-15,17,21,23,29,35-hexamethyl-2,3,10,14,20-pentaoxo-11, 36-dioxa-4-azatricyclo[30.3.1.04,9]hexatriaconta-16,24,26, 28-tetraen-12-yl]propyl]-2-methoxycyclohexyl dimethylphosphinate, also known as AP23573 and MK8669, and described in PCT Publication No. WO 03/064383); everolimus (Afinitor® or RAD001); rapamycin (AY22989, Sirolimus®); simapimod (CAS 164301-51-3); emsirolimus, (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF04691502, CAS 1013101-36-4); and N2-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine- (SEQ ID NO: 1005), inner salt (SF1126, CAS 936487-67-1), and XL765.

Exemplary immunomodulators include, e.g., afutuzumab (available from Roche®); pegfilgrastim (Neulasta®); lenalidomide (CC-5013, Revlimid®); IMIDs (such as thalidomide (Thalomid®), lenalidomide, pomalidomide, and apremilast), actimid (CC4047); and IRX-2 (mixture of human cytokines including interleukin 1, interleukin 2, and interferon γ, CAS 951209-71-5, available from IRX Therapeutics).

Exemplary anthracyclines include, e.g., doxorubicin (Adriamycin® and Rubex®); bleomycin (lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin.

Exemplary vinca alkaloids include, e.g., vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteasome inhibitors include bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

Exemplary BH3 mimetics include venetoclax, ABT-737 (4-{4-[(4'-Chloro-2-biphenylyl)methyl]-1-piperazinyl}-N-[(4-{[(2R)-4-(dimethylamino)-1-(phenylsulfanyl)-2-butanyl]amino}-3-nitrophenyl)sulfonyl]benzamide and navitoclax (formerly ABT-263).

Exemplary cytokine therapies include interleukin 2 (IL-2) and interferon-alpha (IFN-alpha).

In certain aspects, "cocktails" of different chemotherapeutic agents are administered as the additional agent(s).

In some embodiments, a CD2 binding molecule can be used in combination with a member of the thalidomide class of compounds. Members of the thalidomide class of compounds include, but are not limited to, lenalidomide (CC-5013), pomalidomide (CC-4047 or ACTIMID), thalidomide, and salts and derivatives thereof. In some embodiments, the CD2 binding molecule is used in combination with a mixture of one, two, three, or more members of the thalidomide class of compounds. Thalidomide analogs and immunomodulatory properties of thalidomide analogs are described in Bodera and Stankiewicz, Recent Pat Endocr Metab Immune Drug Discov. 2011 September; 5(3): 192-6. The structural complex of thalidomide analogs and the E3 ubiquitin is described in Gandhi et al., Br J Haematol.

2014 March; 164(6):811-21. The modulation of the E3 ubiquitin ligase by thalidomide analogs is described in Fischer et al., Nature. 2014 Aug. 7; 512(7512):49-53.

In some embodiments, the member of the thalidomide class of compounds comprises a compound of Formula (I):

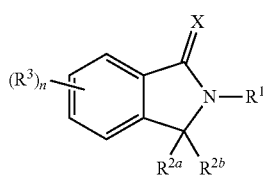

or a pharmaceutically acceptable salt, ester, hydrate, solvate, or tautomer thereof, where:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, where each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), —N($R^C$)S(O)$_x$$R^E$, carbocyclyl, heterocyclyl, aryl, or heteroaryl, where each alkyl, alkenyl, alkynyl, heteroalkyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, where each aryl and heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;

n is 0, 1, 2, 3 or 4; and

X is 0, 1, or 2.

In some embodiments, X is 0.

In some embodiments, $R^1$ is heterocyclyl. In some embodiments, $R^1$ is a 6-membered heterocyclyl or a 5-membered heterocyclyl. In some embodiments, $R^1$ is a nitrogen-containing heterocyclyl. In some embodiments, $R^1$ is piperidinyl (e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, $R^3$ is $C_1$-$C_6$ heteroalkyl, —N($R^C$)($R^D$) or —N($R^C$)(O)$R^A$. In some embodiments, $R^3$ is $C_1$-$C_6$ heteroalkyl (e.g., $CH_2NHC(O)CH_2$-phenyl-t-butyl), —N($R^C$)($R^D$) (e.g., $NH_2$), or —N($R^C$)(O)$R^A$ (e.g., NHC(O) $CH_3$).

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is —N($R^C$)($R^D$) (e.g., —$NH_2$). In an embodiment, the compound comprises lenalidomide, e.g., 3-(4-amino-1-oxoisoindolin-2-yl)piperidine-2,6-dione, or a pharmaceutically acceptable salt thereof. In an embodiment, the compound is lenalidomide, e.g., according to the following formula:

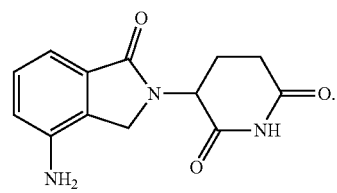 [SMILES: Nc1cccc2c1CN(C1CCC(=O)NC1=O)C2=O]

In an embodiment, X is O. In an embodiment, $R^1$ is heterocyclyl (e.g., piperidinyl-2,6-dionyl). In some embodiments, $R^{2a}$ and $R^{2b}$ together with the carbon to which they are attached form a carbonyl group. In an embodiment, n is 1. In an embodiment, $R^3$ is —N($R^C$)($R^D$) (e.g., —$NH_2$). In an embodiment, the compound comprises pomalidomide, e.g., 4-amino-2-(2,6-dioxopiperidin-3-yl)isoindoline-1,3-dione, or a pharmaceutically acceptable salt thereof. In an embodiment, the compound is pomalidomide, e.g., according to the following formula:

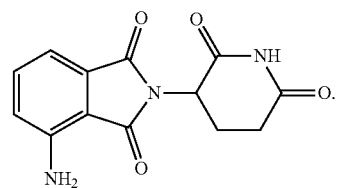

In an embodiment, X is O. In an embodiment, $R^1$ is heterocyclyl (e.g., piperidinyl-2,6-dionyl). In an embodiment, $R^{2a}$ and $R^{2b}$ together with the carbon to which they are attached form a carbonyl group. In an embodiment, n is 0. In an embodiment, the compound comprises thalidomide, e.g., 2-(2,6-dioxopiperidin-3-yl)isoindoline-1,3-dione, or a pharmaceutically acceptable salt thereof. In an embodiment, the product is thalidomide, e.g., according to the following formula:

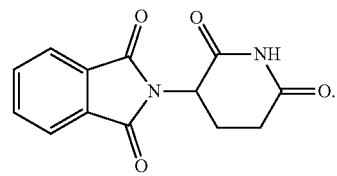 [SMILES: O=C1CCC(N2C(=O)c3ccccc3C2=O)C(=O)N1]

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is $C_1$-$C_6$ heteroalkyl (e.g., $CH_2NHC(O)CH_2$-phenyl-t-butyl) In an embodiment, the compound comprises 2-(4-(tert-butyl)phenyl)-N-((2-(2,6-dioxopiperidin-3-yl)-1-oxoisoindolin-5-yl)methyl)acetamide, or a pharmaceutically acceptable salt thereof. In an embodiment, the compound has the structure as shown in the following formula:

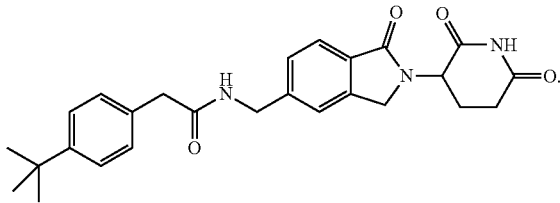 [SMILES: CC(C)(C)c1ccc(CC(=O)NCc2ccc3c(c2)CN(C2CCC(=O)NC2=O)C3=O)cc1]

In some embodiments, the compound is a compound of Formula (I-a):

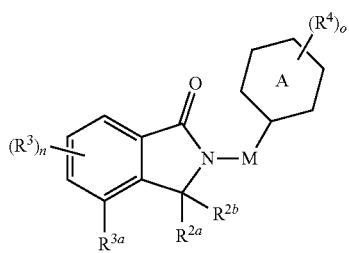

or a pharmaceutically acceptable salt, ester, hydrate, or tautomer thereof, where:

Ring A is carbocyclyl, heterocyclyl, aryl, or heteroaryl, each of which optionally substituted with one or more $R^4$;

M is absent, $C_1$-$C_6$ alkyl, $C_2$-$C_6$ alkenyl, $C_2$-$C_6$ alkynyl, or $C_1$-$C_6$ heteroalkyl, where each alkyl, alkenyl, alkynyl, and heteroalkyl is optionally substituted with one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;

$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, where each alkyl, alkenyl, alkynyl, and heteroalkyl is optionally substituted with one or more $R^6$;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N(R9S(O)$_x$$R^E$, where each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, S(O)$_x$$R^E$, —S(O)$_x$N($R^C$)($R^D$), —N($R^C$)S(O)$_x$$R^E$, carbocyclyl, heterocyclyl, aryl, or heteroaryl, where each alkyl, alkenyl, alkynyl, carbocyclyl, heterocyclyl, aryl, or heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, where each aryl or heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;

n is 0, 1, 2, or 3;
o is 0, 1, 2, 3, 4, or 5; and
x is 0, 1, or 2.

In some embodiments, X is O.
In some embodiments, M is absent.
In some embodiments, Ring A is heterocyclyl. In some embodiments, Ring A is heterocyclyl, e.g., a 6-membered heterocyclyl or a 5-membered heterocyclyl. In some embodiments, Ring A is a nitrogen-containing heterocyclyl. In some embodiments, Ring A is piperidinyl (e.g., piperidine-2,6-dionyl).

In some embodiments, M is absent and Ring A is heterocyclyl (e.g., piperidinyl, e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, $R^{3a}$ is hydrogen, —N($R^C$)($R^D$) or —N($R^C$)(O)$R^A$. In some embodiments, $R^{3a}$ is hydrogen. In some embodiments, $R^{3a}$ is —N($R^C$)($R^D$) (e.g., —NH$_2$). In some embodiments, $R^{3a}$ is —N($R^C$)(O)$R^A$ (e.g, NHC(O)CH$_3$).

In some embodiments, $R^3$ is $C_1$-$C_6$ heteroalkyl (e.g., CH$_2$NHC(O)CH$_2$-phenyl-t-butyl). In some embodiments, n is 0 or 1. In some embodiments, n is O. In some embodiments, n is 1.

The compound can comprise one or more chiral centers or exist as one or more stereoisomers. In some embodiments, the compound comprises a single chiral center and is a mixture of stereoisomers, e.g., an R stereoisomer and an S stereoisomer. In some embodiments, the mixture comprises a ratio of R stereoisomers to S stereoisomers, for example, about a 1:1 ratio of R stereoisomers to S stereoisomers (i.e., a racemic mixture). In some embodiments, the mixture comprises a ratio of R stereoisomers to S stereoisomers of about 51:49, about 52: 48, about 53:47, about 54:46, about 55:45, about 60:40, about 65:35, about 70:30, about 75:25, about 80:20, about 85:15, about 90:10, about 95:5, or about 99:1. In some embodiments, the mixture comprises a ratio of S stereoisomers to R stereoisomers of about 51:49, about 52: 48, about 53:47, about 54:46, about 55:45, about 60:40, about 65:35, about 70:30, about 75:25, about 80:20, about 85:15, about 90:10, about 95:5, or about 99:1. In some embodiments, the compound is a single stereoisomer of Formula (I) or Formula (I-a), e.g., a single R stereoisomer or a single S stereoisomer.

In some embodiments, the CD2 binding molecule is administered in combination with a kinase inhibitor. In one embodiment, the kinase inhibitor is a PI3-kinase inhibitor, e.g., CLR457, BGT226, or BYL719. In one embodiment, the kinase inhibitor is a CDK4 inhibitor, e.g., a CDK4 inhibitor described herein, e.g., a CDK4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo[3,4-d]pyrimidine. The MNK inhibitor can be, e.g., a MNK1a, MNK1b, MNK2a and/or MNK2b inhibitor. In one embodiment, the kinase inhibitor is a dual PI3K/mTOR inhibitor described herein, such as, e.g., PF-04695102. In one embodiment, the kinase inhibitor is a DGK inhibitor, e.g., a DGK inhibitor described herein, such as, e.g., DGKinh1 (D5919) or DGKinh2 (D5794).

In one embodiment, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In an embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment, the kinase inhibitor is a BTK inhibitor, e.g., ibrutinib (PCI-32765). In some embodiments, a CD2 binding molecule is administered to a subject in combination with a BTK inhibitor (e.g., ibrutinib). In embodiments, a CD2 binding molecule is administered to a subject in combination with ibrutinib (also called PCI-32765) (e.g., to a subject having CLL, mantle cell lymphoma (MCL), or small lymphocytic lymphoma (SLL). For example, the subject can have a deletion in the short arm of chromosome 17 (del(17p), e.g., in a leukemic cell). In other examples, the subject does not have a del(17p). In some embodiments, the subject has relapsed CLL or SLL, e.g., the subject has previously been administered a cancer therapy (e.g., previously been administered one, two, three, or four prior cancer therapies). In some embodiments, the subject has refractory CLL or SLL. In other embodiments, the subject has follicular lymphoma, e.g., relapse or refractory follicular lymphoma. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In some embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered. In some embodiments, ibrutinib is administered in combination with rituximab. See, e.g., Burger et al., 2013. Ibrutinib In Combination With Rituximab (iR) Is Well Tolerated and Induces a High Rate Of Durable Remissions In Patients With High-Risk Chronic Lymphocytic Leukemia (CLL): New, Updated Results Of a Phase II Trial In 40 Patients, Abstract 675 presented at 55th ASH Annual Meeting and Exposition, New Orleans, LA 7-10 December Without being bound by theory, it is thought that the addition of ibrutinib enhances the T cell proliferative response and can shift T cells from a T-helper-2 (Th2) to T-helper-1 (Th1) phenotype. Th1 and Th2 are phenotypes of helper T cells, with Th1 versus Th2 directing different immune response pathways. A Th1 phenotype is associated with proinflammatory responses, e.g., for killing cells, such as intracellular pathogens/viruses or cancerous cells, or perpetuating autoimmune responses. A Th2 phenotype is associated with eosinophil accumulation and anti-inflammatory responses.

In some embodiments, the CD2 binding molecule is administered in combination with an inhibitor of Epidermal Growth Factor Receptor (EGFR).

In some embodiments, the EGFR inhibitor is (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757.

In some embodiments, the EGFR inhibitor, e.g., (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757, is administered at a dose of 150-250 mg, e.g., per day. In some embodiments, the EGFR inhibitor, e.g., (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757, is administered at a dose of about 150, 200, or 250 mg, or about 150-200 or 200-250 mg.

In some embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757, is a covalent, irreversible tyrosine kinase inhibitor. In certain embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 inhibits activating EGFR mutations (L858R, ex19del). In other embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 does not inhibit, or does not substantially inhibit, wild-type (wt) EGFR. Compound A40 has shown efficacy in EGFR mutant NSCLC patients. In some embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757 also inhibits one or more kinases in the TEC family of kinases. The Tec family kinases include, e.g., ITK, BMX, TEC, RLK, and BTK, and are central in the propagation of T-cell receptor and chemokine receptor signaling (Schwartzberg et al. (2005) Nat. Rev. Immunol. p. 284-95). For example, Compound A40 can inhibit ITK with a biochemical IC50 of 1.3 nM. ITK is a critical enzyme for the survival of Th2 cells and its inhibition results in a shift in the balance between Th2 and Th1 cells.

In some embodiments, the EGFR inhibitor is chosen from one of more of erlotinib, gefitinib, cetuximab, panitumumab, necitumumab, PF-00299804, nimotuzumab, or R05083945.

In some embodiments, the CD2 binding molecule is administered in combination with an adenosine A2A receptor (A2AR) antagonist. Exemplary A2AR antagonists include, e.g., PBF509 (Palobiofarma/Novartis), CPI444/V81444 (Corvus/Genentech), AZD4635/HTL-1071 (AstraZeneca/Heptares), Vipadenant (Redox/Juno), GBV-2034 (Globavir), AB928 (Arcus Biosciences), Theophylline, Istradefylline (Kyowa Hakko Kogyo), Tozadenant/SYN-115 (Acorda), KW-6356 (Kyowa Hakko Kogyo), ST-4206 (Leadiant Biosciences), Preladenant/SCH 420814 (Merck/Schering), and NIR178 (Novartis).

In certain embodiments, the A2AR antagonist is PBF509. PBF509 and other A2AR antagonists are disclosed in U.S.

Pat. No. 8,796,284 and WO 2017/025918. In certain embodiments, the A2AR antagonist is 5-bromo-2,6-di-(1H-pyrazol-1-yl)pyrimidine-4-amine. In certain embodiments, the A2AR antagonist has the following structure:

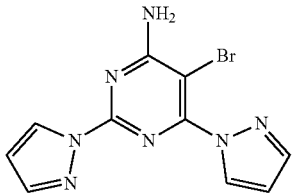 [SMILES: Nc1nc(-n2cccn2)nc(-n2cccn2)c1Br]

In certain embodiments, the A2AR antagonist is CPI444/V81444. CPI-444 and other A2AR antagonists are disclosed in WO 2009/156737. In certain embodiments, the A2AR antagonist is (S)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine. In certain embodiments, the A2AR antagonist is (R)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or racemate thereof. In certain embodiments, the A2AR antagonist is 7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine. In certain embodiments, the A2AR antagonist has the following structure:

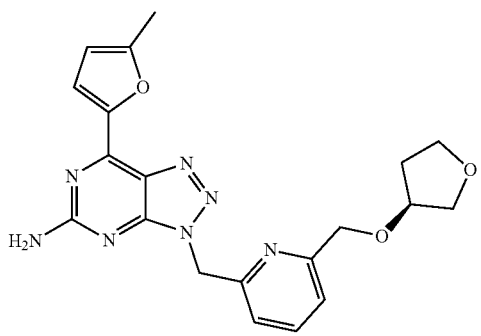 [SMILES: Cc1ccc(-c2nc(N)nc3c2nnn3Cc2cccc(CO[C@H]3CCOC3)n2)o1]

In certain embodiments, the A2AR antagonist is AZD4635/HTL-1071. A2AR antagonists are disclosed in WO 2011/095625. In certain embodiments, the A2AR antagonist is 6-(2-chloro-6-methylpyridin-4-yl)-5-(4-fluorophenyl)-1,2,4-triazin-3-amine. In certain embodiments, the A2AR antagonist has the following structure:

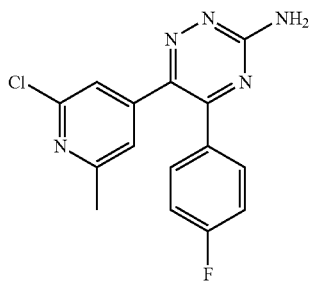 [SMILES: Cc1cc(-c2nnc(N)nc2-c2ccc(F)cc2)cc(Cl)n1]

In certain embodiments, the A2AR antagonist is ST-4206 (Leadiant Biosciences). In certain embodiments, the A2AR antagonist is an A2AR antagonist described in U.S. Pat. No. 9,133,197. In certain embodiments, the A2AR antagonist has the following structure:

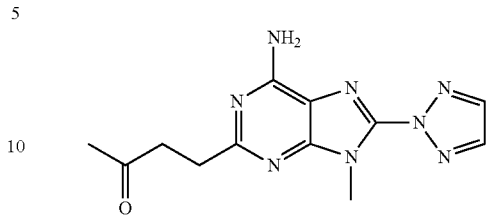

In certain embodiments, the A2AR antagonist is an A2AR antagonist described in U.S. Pat. Nos. 8,114,845, 9,029,393, US20170015758, or US20160129108.

In certain embodiments, the A2AR antagonist is istradefylline (CAS Registry Number: 155270-99-8). Istradefylline is also known as KW-6002 or 8-[(E)-2-(3,4-dimethoxyphenyl)vinyl]-1,3-diethyl-7-methyl-3,7-dihydro-1H-purine-2,6-dione. Istradefylline is disclosed, e.g., in LeWitt et al. (2008) Annals of Neurology 63 (3): 295-302).

In certain embodiments, the A2aR antagonist is tozadenant (Biotie). Tozadenant is also known as SYN115 or 4-hydroxy-N-(4-methoxy-7-morpholin-4-yl-1,3-benzothiazol-2-yl)-4-methylpiperidine-1-carboxamide. Tozadenant blocks the effect of endogenous adenosine at the A2a receptors, resulting in the potentiation of the effect of dopamine at the D2 receptor and inhibition of the effect of glutamate at the mGluR5 receptor. In some embodiments, the A2aR antagonist is preladenant (CAS Registry Number: 377727-87-2). Preladenant is also known as SCH 420814 or 2-(2-Furanyl)-7-[2-[4-[4-(2-methoxyethoxy)phenyl]-1-piperazinyl]ethyl]7H-pyrazolo[4,3-e][1,2,4]triazolo[1,5-c] pyrimidine-5-amine. Preladenant was developed as a drug that acted as a potent and selective antagonist at the adenosine A2A receptor.

In certain embodiments, the A2aR antagonist is vipadenan. Vipadenan is also known as BIIB014, V2006, or 3-[(4-amino-3-methylphenyl)methyl]-7-(furan-2-yl)triazolo[4,5-d]pyrimidin-5-amine.

Other exemplary A2aR antagonists include, e.g., ATL-444, MSX-3, SCH-58261, SCH-412,348, SCH-442,416, VER-6623, VER-6947, VER-7835, CGS-15943, or ZM-241,385.

In some embodiments, the A2aR antagonist is an A2aR pathway antagonist (e.g., a CD-73 inhibitor, e.g., an anti-CD73 antibody) is MEDI9447. MEDI9447 is a monoclonal antibody specific for CD73. Targeting the extracellular production of adenosine by CD73 can reduce the immunosuppressive effects of adenosine. MEDI9447 was reported to have a range of activities, e.g., inhibition of CD73 ectonucleotidase activity, relief from AMP-mediated lymphocyte suppression, and inhibition of syngeneic tumor growth. MEDI9447 can drive changes in both myeloid and lymphoid infiltrating leukocyte populations within the tumor microenvironment. These changes include, e.g., increases in CD8 effector cells and activated macrophages, as well as a reduction in the proportions of myeloid-derived suppressor cells (MDSC) and regulatory T lymphocytes.

In some embodiments, the CD2 binding molecule is administered in combination with a CD20 inhibitor.

In one embodiment, the CD20 inhibitor is an anti-CD20 antibody or fragment thereof. In an embodiment, the antibody is a monospecific antibody and in another embodiment, the antibody is a bispecific antibody. In an embodiment, the CD20 inhibitor is a chimeric mouse/human monoclonal antibody, e.g., rituximab. In an embodiment, the CD20 inhibitor is a human monoclonal antibody such as ofatumumab. In an embodiment, the CD20 inhibitor is a humanized antibody such as ocrelizumab, veltuzumab, obinutuzumab, ocaratuzumab, or PRO131921 (Genentech). In an embodiment, the CD20 inhibitor is a fusion protein comprising a portion of an anti-CD20 antibody, such as TRU-015 (Trubion Pharmaceuticals).

In some embodiments, the CD2 binding molecule is administered in combination with a CD22 inhibitor. In some embodiments, the CD22 inhibitor is a small molecule or an anti-CD22 antibody molecule. In some embodiments, the antibody is a monospecific antibody, optionally conjugated to a second agent such as a chemotherapeutic agent. For instance, in an embodiment, the antibody is an anti-CD22 monoclonal antibody-MMAE conjugate (e.g., DCDT2980S). In an embodiment, the antibody is an scFv of an anti-CD22 antibody, e.g., an scFv of antibody RFB4. This scFv can be fused to all of or a fragment of *Pseudomonas* exotoxin-A (e.g., BL22). In an embodiment, the antibody is a humanized anti-CD22 monoclonal antibody (e.g., epratuzumab). In an embodiment, the antibody or fragment thereof comprises the Fv portion of an anti-CD22 antibody, which is optionally covalently fused to all or a fragment or (e.g., a 38 KDa fragment of) *Pseudomonas* exotoxin-A (e.g., moxetumomab pasudotox). In an embodiment, the anti-CD22 antibody is an anti-CD19/CD22 bispecific antibody, optionally conjugated to a toxin. For instance, in one embodiment, the anti-CD22 antibody comprises an anti-CD19/CD22 bispecific portion, (e.g., two scFv ligands, recognizing human CD19 and CD22) optionally linked to all of or a portion of diphtheria toxin (DT), e.g., first 389 amino acids of diphtheria toxin (DT), DT 390, e.g., a ligand-directed toxin such as DT2219ARL). In another embodiment, the bispecific portion (e.g., anti-CD19/anti-CD22) is linked to a toxin such as deglycosylated ricin A chain (e.g., Combotox).

In some embodiments, the CD22 inhibitor is a multispecific antibody molecule, e.g., a bispecific antibody molecule, e.g., a bispecific antibody molecule that binds to CD20 and CD3. Exemplary bispecific antibody molecules that bind to CD20 and CD3 are disclosed in WO2016086189 and WO2016182751. In some embodiments, the bispecific antibody molecule that binds to CD20 and CD3 is XENP13676 as disclosed in FIG. 74, SEQ ID NOs: 323, 324, and 325 of WO2016086189.

In some embodiments, the CD2 binding molecule is administered in combination with a FCRL2 or FCRL5 inhibitor. In some embodiments, the FCRL2 or FCRL5 inhibitor is an anti-FCRL2 antibody molecule, e.g., a bispecific antibody molecule, e.g., a bispecific antibody that binds to FCRL2 and CD3. In some embodiments, the FCRL2 or FCRL5 inhibitor is an anti-FCRL5 antibody molecule, e.g., a bispecific antibody molecule, e.g., a bispecific antibody that binds to FCRL5 and CD3.

Exemplary anti-FCRL5 antibody molecules are disclosed in US20150098900, US20160368985, WO2017096120 (e.g., antibodies ET200-001, ET200-002, ET200-003, ET200-006, ET200-007, ET200-008, ET200-009, ET200-010, ET200-011, ET200-012, ET200-013, ET200-014, ET200-015, ET200-016, ET200-017, ET200-018, ET200-019, ET200-020, ET200-021, ET200-022, ET200-023, ET200-024, ET200-025, ET200-026, ET200-027, ET200-028, ET200-029, ET200-030, ET200-031, ET200-032, ET200-033, ET200-034, ET200-035, ET200-037, ET200-038, ET200-039, ET200-040, ET200-041, ET200-042, ET200-043, ET200-044, ET200-045, ET200-069, ET200-078, ET200-079, ET200-081, ET200-097, ET200-098, ET200-099, ET200-100, ET200-101, ET200-102, ET200-103, ET200-104, ET200-105, ET200-106, ET200-107, ET200-108, ET200-109, ET200-110, ET200-111, ET200-112, ET200-113, ET200-114, ET200-115, ET200-116, ET200-117, ET200-118, ET200-119, ET200-120, ET200-121, ET200-122, ET200-123, ET200-125, ET200-005 and ET200-124 disclosed in WO2017096120).

In some embodiments, the CD2 binding molecule is administered in combination with an IL15/IL-15Ra complex. In some embodiments, the IL-15/IL-15Ra complex is chosen from NIZ985 (Novartis), ATL-803 (Altor) or CYP0150 (Cytune).

In some embodiments, the IL-15/IL-15Ra complex comprises human IL-15 complexed with a soluble form of human IL-15Ra. The complex can comprise IL-15 covalently or noncovalently bound to a soluble form of IL-15Ra. In a particular embodiment, the human IL-15 is noncovalently bonded to a soluble form of IL-15Ra. In a particular embodiment, the human IL-15 of the composition comprises an amino acid sequence as described in WO 2014/066527 and the soluble form of human IL-15Ra comprises an amino acid sequence as described in WO 2014/066527. The molecules described herein can be made by vectors, host cells, and methods described in WO 2007/084342.

In some embodiments, the IL-15/IL-15Ra complex is ALT-803, an IL-15/IL-15Ra Fc fusion protein (IL-15N72D:IL-15RaSu/Fc soluble complex). ALT-803 is disclosed in WO 2008/143794.

In some embodiments, the IL-15/IL-15Ra complex comprises IL-15 fused to the sushi domain of IL-15Ra (CYP0150, Cytune). The sushi domain of IL-15Ra refers to a domain beginning at the first cysteine residue after the signal peptide of IL-15Ra, and ending at the fourth cysteine residue after the signal peptide. The complex of IL-15 fused to the sushi domain of IL-15Ra is disclosed in WO 2007/04606 and WO 2012/175222.

In some embodiments, the CD2 binding molecule is administered in combination with a PD-1 inhibitor. In some embodiments, the PD-1 inhibitor is chosen from PDR001 (Novartis), Nivolumab (Bristol-Myers Squibb), Pembrolizumab (Merck & Co), Pidilizumab (CureTech), MED10680 (Medimmune), REGN2810 (Regeneron), TSR-042 (Tesaro), PF-06801591 (Pfizer), BGB-A317 (Beigene), BGB-108 (Beigene), INCSHR1210 (Incyte), or AMP-224 (Amplimmune). In one embodiment, the PD-1 inhibitor is an anti-PD-1 antibody molecule. In one embodiment, the PD-1 inhibitor is an anti-PD-1 antibody molecule as described in US 2015/0210769.

In one embodiment, the anti-PD-1 antibody molecule is Nivolumab (Bristol-Myers Squibb), also known as MDX-1106, MDX-1106-04, ONO-4538, BMS-936558, or OPDIVO®. Nivolumab (clone 5C4) and other anti-PD-1 antibodies are disclosed in U.S. Pat. No. 8,008,449 and WO 2006/121168. In one embodiment, the anti-PD-1 antibody molecule comprises one or more of the CDR sequences (or collectively all of the CDR sequences), the heavy chain or light chain variable region sequence, or the heavy chain or light chain sequence of Nivolumab.

In one embodiment, the anti-PD-1 antibody molecule is Pembrolizumab (Merck & Co), also known as Lambrolizumab, MK-3475, MK03475, SCH-900475, or KEYTRUDA®. Pembrolizumab and other anti-PD-1 antibodies are disclosed in Hamid, O. et al. (2013) *New England Journal of Medicine* 369 (2): 134-44, U.S. Pat. No. 8,354,509, and WO 2009/114335. In one embodiment, the anti- PD-1 antibody molecule comprises one or more of the CDR sequences (or collectively all of the CDR sequences), the heavy chain or light chain variable region sequence, or the heavy chain or light chain sequence of Pembrolizumab.

In one embodiment, the anti-PD-1 antibody molecule is Pidilizumab (CureTech), also known as CT-011. Pidilizumab and other anti-PD-1 antibodies are disclosed in Rosenblatt, J. et al. (2011) *J Immunotherapy* 34(5): 409-18, U.S. Pat. Nos. 7,695,715, 7,332,582, and 8,686,119. In one embodiment, the anti-PD-1 antibody molecule comprises one or more of the CDR sequences (or collectively all of the CDR sequences), the heavy chain or light chain variable region sequence, or the heavy chain or light chain sequence of Pidilizumab.

In one embodiment, the anti-PD-1 antibody molecule is MED10680 (Medimmune), also known as AMP-514. MED10680 and other anti-PD-1 antibodies are disclosed in U.S. Pat. No. 9,205,148 and WO 2012/145493. In one embodiment, the anti-PD-1 antibody molecule comprises one or more of the CDR sequences (or collectively all of the CDR sequences), the heavy chain or light chain variable region sequence, or the heavy chain or light chain sequence of MED10680.

In one embodiment, the anti-PD-1 antibody molecule is REGN2810 (Regeneron). In one embodiment, the anti-PD-1 antibody molecule comprises one or more of the CDR sequences (or collectively all of the CDR sequences), the heavy chain or light chain variable region sequence, or the heavy chain or light chain sequence of REGN2810.

In one embodiment, the anti-PD-1 antibody molecule is PF-06801591 (Pfizer). In one embodiment, the anti-PD-1 antibody molecule comprises one or more of the CDR sequences (or collectively all of the CDR sequences), the heavy chain or light chain variable region sequence, or the heavy chain or light chain sequence of PF-06801591.

In one embodiment, the anti-PD-1 antibody molecule is BGB-A317 or BGB-108 (Beigene). In one embodiment, the anti-PD-1 antibody molecule comprises one or more of the CDR sequences (or collectively all of the CDR sequences), the heavy chain or light chain variable region sequence, or the heavy chain or light chain sequence of BGB-A317 or BGB-108.

In one embodiment, the anti-PD-1 antibody molecule is INCSHR1210 (Incyte), also known as INCSHR01210 or SHR-1210. In one embodiment, the anti-PD-1 antibody molecule comprises one or more of the CDR sequences (or collectively all of the CDR sequences), the heavy chain or light chain variable region sequence, or the heavy chain or light chain sequence of INCSHR1210.

In one embodiment, the anti-PD-1 antibody molecule is TSR-042 (Tesaro), also known as ANB011. In one embodiment, the anti-PD-1 antibody molecule comprises one or more of the CDR sequences (or collectively all of the CDR sequences), the heavy chain or light chain variable region sequence, or the heavy chain or light chain sequence of TSR-042.

Further known anti-PD-1 antibodies include those described, e.g., in WO 2015/112800, WO 2016/092419, WO 2015/085847, WO 2014/179664, WO 2014/194302, WO 2014/209804, WO 2015/200119, U.S. Pat. Nos. 8,735,553, 7,488,802, 8,927,697, 8,993,731, and 9,102,727.

In one embodiment, the anti-PD-1 antibody is an antibody that competes for binding with, and/or binds to the same epitope on PD-1 as, one of the anti-PD-1 antibodies described herein.

In one embodiment, the PD-1 inhibitor is a peptide that inhibits the PD-1 signaling pathway, e.g., as described in U.S. Pat. No. 8,907,053. In one embodiment, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In one embodiment, the PD-1 inhibitor is AMP-224 (B7-DCIg (Amplimmune), e.g., disclosed in WO 2010/027827 and WO 2011/066342).

In some embodiments, the CD2 binding molecule is administered in combination with a PD-L1 inhibitor. In some embodiments, the PD-L1 inhibitor is chosen from FAZ053 (Novartis), Atezolizumab (Genentech/Roche), Avelumab (Merck Serono and Pfizer), Durvalumab (Medlmmune/AstraZeneca), or BMS-936559 (Bristol-Myers Squibb).

In one embodiment, the PD-L1 inhibitor is an anti-PD-L1 antibody molecule. In one embodiment, the PD-L1 inhibitor is an anti-PD-L1 antibody molecule as disclosed in US 2016/0108123.

In one embodiment, the anti-PD-L1 antibody molecule is Atezolizumab (Genentech/Roche), also known as MPDL3280A, RG7446, R05541267, YW243.55.S70, or TECENTRIQ™. Atezolizumab and other anti-PD-L1 antibodies are disclosed in U.S. Pat. No. 8,217,149. In one embodiment, the anti-PD-L1 antibody molecule comprises one or more of the CDR sequences (or collectively all of the CDR sequences), the heavy chain or light chain variable region sequence, or the heavy chain or light chain sequence of Atezolizumab.

In one embodiment, the anti-PD-L1 antibody molecule is Avelumab (Merck Serono and Pfizer), also known as MSB0010718C. Avelumab and other anti-PD-L1 antibodies are disclosed in WO 2013/079174. In one embodiment, the anti-PD-L1 antibody molecule comprises one or more of the CDR sequences (or collectively all of the CDR sequences), the heavy chain or light chain variable region sequence, or the heavy chain or light chain sequence of Avelumab.

In one embodiment, the anti-PD-L1 antibody molecule is Durvalumab (Medlmmune/AstraZeneca), also known as MED14736. Durvalumab and other anti-PD-L1 antibodies are disclosed in U.S. Pat. No. 8,779,108. In one embodiment, the anti-PD-L1 antibody molecule comprises one or more of the CDR sequences (or collectively all of the CDR sequences), the heavy chain or light chain variable region sequence, or the heavy chain or light chain sequence of Durvalumab.

In one embodiment, the anti-PD-L1 antibody molecule is BMS-936559 (Bristol-Myers Squibb), also known as MDX-1105 or 12A4. BMS-936559 and other anti-PD-L1 antibodies are disclosed in U.S. Pat. No. 7,943,743 and WO 2015/081158. In one embodiment, the anti-PD-L1 antibody molecule comprises one or more of the CDR sequences (or collectively all of the CDR sequences), the heavy chain or light chain variable region sequence, or the heavy chain or light chain sequence of BMS-936559.

Further known anti-PD-L1 antibodies include those described, e.g., in WO 2015/181342, WO 2014/100079, WO 2016/000619, WO 2014/022758, WO 2014/055897, WO 2015/061668, WO 2013/079174, WO 2012/145493, WO 2015/112805, WO 2015/109124, WO 2015/195163, U.S. Pat. Nos. 8,168,179, 8,552,154, 8,460,927, and 9,175,082.

In some embodiments, the CD2 binding molecule is administered in combination with a LAG-3 inhibitor. In some embodiments, the LAG-3 inhibitor is chosen from LAG525 (Novartis), BMS-986016 (Bristol-Myers Squibb), or TSR-033 (Tesaro).

In one embodiment, the LAG-3 inhibitor is an anti-LAG-3 antibody molecule. In one embodiment, the LAG-3 inhibitor is an anti-LAG-3 antibody molecule as disclosed in US 2015/0259420.

In one embodiment, the anti-LAG-3 antibody molecule is BMS-986016 (Bristol-Myers Squibb), also known as BMS986016. BMS-986016 and other anti-LAG-3 antibodies are disclosed in WO 2015/116539 and U.S. Pat. No. 9,505,839. In one embodiment, the anti-LAG-3 antibody molecule comprises one or more of the CDR sequences (or collectively all of the CDR sequences), the heavy chain or light chain variable region sequence, or the heavy chain or light chain sequence of BMS-986016.

In one embodiment, the anti-LAG-3 antibody molecule is TSR-033 (Tesaro). In one embodiment, the anti-LAG-3 antibody molecule comprises one or more of the CDR sequences (or collectively all of the CDR sequences), the heavy chain or light chain variable region sequence, or the heavy chain or light chain sequence of TSR-033.

In one embodiment, the anti-LAG-3 antibody molecule is IMP731 or GSK2831781 (GSK and Prima BioMed). IMP731 and other anti-LAG-3 antibodies are disclosed in WO 2008/132601 and U.S. Pat. No. 9,244,059. In one embodiment, the anti-LAG-3 antibody molecule comprises one or more of the CDR sequences (or collectively all of the CDR sequences), the heavy chain or light chain variable region sequence, or the heavy chain or light chain sequence of IMP731. In one embodiment, the anti-LAG-3 antibody molecule comprises one or more of the CDR sequences (or collectively all of the CDR sequences), the heavy chain or light chain variable region sequence, or the heavy chain or light chain sequence of GSK2831781.

Further known anti-LAG-3 antibodies include those described, e.g., in WO 2008/132601, WO 2010/019570, WO 2014/140180, WO 2015/116539, WO 2015/200119, WO 2016/028672, U.S. Pat. Nos. 9,244,059, 9,505,839.

In one embodiment, the anti-LAG-3 inhibitor is a soluble LAG-3 protein, e.g., IMP321 (Prima BioMed), e.g., as disclosed in WO 2009/044273.

In some embodiments, the CD2 binding molecule is administered in combination with a TIM-3 inhibitor. In some embodiments, the TIM-3 inhibitor is MBG453 (Novartis) or TSR-022 (Tesaro).

In one embodiment, the TIM-3 inhibitor is an anti-TIM-3 antibody molecule. In one embodiment, the TIM-3 inhibitor is an anti-TIM-3 antibody molecule as disclosed in US 2015/0218274.

In one embodiment, the anti-TIM-3 antibody molecule is TSR-022 (AnaptysBio/Tesaro). In one embodiment, the anti-TIM-3 antibody molecule comprises one or more of the CDR sequences (or collectively all of the CDR sequences), the heavy chain or light chain variable region sequence, or the heavy chain or light chain sequence of TSR-022. In one embodiment, the anti-TIM-3 antibody molecule comprises one or more of the CDR sequences (or collectively all of the CDR sequences), the heavy chain or light chain variable region sequence, or the heavy chain or light chain sequence of APE5137 or APE5121. APE5137, APE5121, and other anti-TIM-3 antibodies are disclosed in WO 2016/161270.

In one embodiment, the anti-TIM-3 antibody molecule is the antibody clone F38-2E2. In one embodiment, the anti-TIM-3 antibody molecule comprises one or more of the CDR sequences (or collectively all of the CDR sequences), the heavy chain or light chain variable region sequence, or the heavy chain or light chain sequence of F38-2E2.

Further known anti-TIM-3 antibodies include those described, e.g., in WO 2016/111947, WO 2016/071448, WO 2016/144803, U.S. Pat. Nos. 8,552,156, 8,841,418, and 9,163,087.

In one embodiment, the anti-TIM-3 antibody is an antibody that competes for binding with, and/or binds to the same epitope on TIM-3 as, one of the anti-TIM-3 antibodies described herein.

In some embodiments, the CD2 binding molecule is administered in combination with a transforming growth factor beta (TGF-β) inhibitor. In some embodiments, the TGF-β inhibitor is fresolimumab (CAS Registry Number: 948564-73-6). Fresolimumab is also known as GC1008. Fresolimumab is a human monoclonal antibody that binds to and inhibits TGF-beta isoforms 1, 2 and 3. Fresolimumab is disclosed, e.g., in WO 2006/086469, U.S. Pat. Nos. 8,383,780, and 8,591,901.

In some embodiments, the TGF-β inhibitor is XOMA 089. XOMA 089 is also known as XPA.42.089. XOMA 089 is a fully human monoclonal antibody that binds and neutralizes TGF-beta 1 and 2 ligands, and is disclosed in PCT Publication No. WO 2012/167143.

In some embodiments, the CD2 binding molecule is administered in combination with an anti-CD73 antibody molecule. In one embodiment, an anti-CD73 antibody molecule is a full antibody molecule or an antigen-binding fragment thereof. In certain embodiments, the anti-CD73 antibody molecule binds to a CD73 protein and reduces, e.g., inhibits or antagonizes, an activity of CD73, e.g., human CD73.

In one embodiment, the anti-CD73 antibody molecule is an anti-CD73 antibody disclosed in WO2016/075099. In one embodiment, the anti-CD73 antibody molecule is MEDI 9447, e.g., as disclosed in WO2016/075099. Alternative names for MEDI 9447 include clone 10.3 or 73combo3. MEDI 9447 is an IgG1 antibody that inhibits, e.g., antagonizes, an activity of CD73. MEDI 9447 and other anti-CD73 antibody molecules are also disclosed in WO2016/075176 and US2016/0129108.

In one embodiment, the anti-CD73 antibody molecule comprises a heavy chain variable domain, a light chain variable domain, or both, of MEDI 9477.

In one embodiment, the anti-CD73 antibody molecule is an anti-CD73 antibody disclosed in WO2016/081748. In one embodiment, the anti-CD73 antibody molecule is 11F11, e.g., as disclosed in WO2016/081748. 11F11 is an IgG2 antibody that inhibits, e.g., antagonizes, an activity of CD73. Antibodies derived from 11F11, e.g., CD73.4, and CD73.10; clones of 11F11, e.g., 11F11-1 and 11F11-2; and other anti-CD73 antibody molecules are disclosed in WO2016/081748 and U.S. Pat. No. 9,605,080.

In one embodiment, the anti-CD73 antibody molecule comprises a heavy chain variable domain, a light chain variable domain, or both, of 11F11-1 or 11F11-2.

In one embodiment, the anti-CD73 antibody molecule is an anti-CD73 antibody disclosed in e.g., U.S. Pat. No. 9,605,080.

In one embodiment, the anti-CD73 antibody molecule is CD73.4, e.g., as disclosed in U.S. Pat. No. 9,605,080. In one embodiment, the anti-CD73 antibody molecule comprises a heavy chain variable domain, a light chain variable domain, or both, of CD73.4.

In one embodiment, the anti-CD73 antibody molecule is CD73.10, e.g., as disclosed in U.S. Pat. No. 9,605,080. In one embodiment, the anti-CD73 antibody molecule comprises a heavy chain variable domain, a light chain variable domain, or both, of CD73.10.

In one embodiment, the anti-CD73 antibody molecule is an anti-CD73 antibody disclosed in WO2009/0203538. In one embodiment, the anti-CD73 antibody molecule is 067-213, e.g., as disclosed in WO2009/0203538.

In one embodiment, the anti-CD73 antibody molecule comprises a heavy chain variable domain, a light chain variable domain, or both, of 067-213.

In one embodiment, the anti-CD73 antibody molecule is an anti-CD73 antibody disclosed in U.S. Pat. No. 9,090,697. In one embodiment, the anti-CD73 antibody molecule is TY/23, e.g., as disclosed in U.S. Pat. No. 9,090,697. In one embodiment, the anti-CD73 antibody molecule comprises a heavy chain variable domain, a light chain variable domain, or both, of TY/23.

In one embodiment, the anti-CD73 antibody molecule is an anti-CD73 antibody disclosed in WO2016/055609. In one embodiment, the anti-CD73 antibody molecule comprises a heavy chain variable domain, a light chain variable domain, or both, of an anti-CD73 antibody disclosed in WO2016/055609.

In one embodiment, the anti-CD73 antibody molecule is an anti-CD73 antibody disclosed in WO2016/146818. In one embodiment, the anti-CD73 antibody molecule comprises a heavy chain variable domain, a light chain variable domain, or both, of an anti-CD73 antibody disclosed in WO2016/146818.

In one embodiment, the anti-CD73 antibody molecule is an anti-CD73 antibody disclosed in WO2004/079013. In one embodiment, the anti-CD73 antibody molecule comprises a heavy chain variable domain, a light chain variable domain, or both, of an anti-CD73 antibody disclosed in WO2004/079013.

In one embodiment, the anti-CD73 antibody molecule is an anti-CD73 antibody disclosed in WO2012/125850. In one embodiment, the anti-CD73 antibody molecule comprises a heavy chain variable domain, a light chain variable domain, or both, of an anti-CD73 antibody disclosed in WO2012/125850.

In one embodiment, the anti-CD73 antibody molecule is an anti-CD73 antibody disclosed in WO2015/004400. In one embodiment, the anti-CD73 antibody molecule comprises a heavy chain variable domain, a light chain variable domain, or both, of an anti-CD73 antibody disclosed in WO2015/004400.

In one embodiment, the anti-CD73 antibody molecule is an anti-CD73 antibody disclosed in WO2007/146968. In one embodiment, the anti-CD73 antibody molecule comprises a heavy chain variable domain, a light chain variable domain, or both, of an anti-CD73 antibody disclosed in WO2007146968.

In one embodiment, the anti-CD73 antibody molecule is an anti-CD73 antibody disclosed in US2007/0042392. In one embodiment, the anti-CD73 antibody molecule comprises a heavy chain variable domain, a light chain variable domain, or both, of an anti-CD73 antibody disclosed in US2007/0042392.

In one embodiment, the anti-CD73 antibody molecule is an anti-CD73 antibody disclosed in US2009/0138977. In one embodiment, the anti-CD73 antibody molecule comprises a heavy chain variable domain, a light chain variable domain, or both, of an anti-CD73 antibody disclosed in US2009/0138977.

In one embodiment, the anti-CD73 antibody molecule is an anti-CD73 antibody disclosed in Flocke et al., Eur J Cell Biol. 1992 June; 58(1):62-70. In one embodiment, the anti-CD73 antibody molecule comprises a heavy chain variable domain, a light chain variable domain, or both, of an anti-CD73 antibody disclosed in Flocke et al., Eur J Cell Biol. 1992 June; 58(1):62-70.

In one embodiment, the anti-CD73 antibody molecule is an anti-CD73 antibody disclosed in Stagg et al., PNAS. 2010 January 107(4): 1547-1552. In some embodiments, the anti-CD73 antibody molecule is TY/23 or TY11.8, as disclosed in Stagg et al. In one embodiment, the anti-CD73 antibody molecule comprises a heavy chain variable domain, a light chain variable domain, or both, of an anti-CD73 antibody disclosed in Stagg et al.

In some embodiments, the CD2 binding molecule is administered in combination with an interleukine-17 (IL-17) inhibitor.

In some embodiments, the IL-17 inhibitor is secukinumab (CAS Registry Numbers: 875356-43-7 (heavy chain) and 875356-44-8 (light chain)). Secukinumab is also known as AIN457 and COSENTYX®. Secukinumab is a recombinant human monoclonal IgG1/K antibody that binds specifically to IL-17A. It is expressed in a recombinant Chinese Hamster Ovary (CHO) cell line. Secukinumab is described, e.g., in WO 2006/013107, U.S. Pat. Nos. 7,807,155, 8,119,131, 8,617,552, and EP 1776142.

In some embodiments, the IL-17 inhibitor is CJM112. CJM112 is also known as XAB4. CJM112 is a fully human monoclonal antibody (e.g., of the IgG1/K isotype) that targets IL-17A. CJM112 is disclosed, e.g., in WO 2014/122613.

CJM112 can bind to human, cynomolgus, mouse and rat IL-17A and neutralize the bioactivity of these cytokines in vitro and in vivo. IL-17A, a member of the IL-17 family, is a major proinflammatory cytokine that has been indicated to play important roles in many immune mediated conditions, such as psoriasis and cancers (Witowski et al. (2004) Cell Mol. Life Sci. p. 567-79; Miossec and Kolls (2012) Nat. Rev. Drug Discov. p. 763-76).

In some embodiments, the IL-17 inhibitor is ixekizumab (CAS Registry Number: 1143503-69-8). Ixekizumab is also known as LY2439821. Ixekizumab is a humanized IgG4 monoclonal antibody that targets IL-17A. Ixekizumab is described, e.g., in WO 2007/070750, U.S. Pat. Nos. 7,838,638, and 8,110,191.

In some embodiments, the IL-17 inhibitor is brodalumab (CAS Registry Number: 1174395-19-7). Brodalumab is also known as AMG 827 or AM-14. Brodalumab binds to the interleukin-17 receptor A (IL-17R$^A$) and prevents IL-17 from activating the receptor. Brodalumab is disclosed, e.g., in WO 2008/054603, U.S. Pat. Nos. 7,767,206, 7,786,284, 7,833,527, 7,939,070, 8,435,518, 8,545,842, 8,790,648, and 9,073,999.

In some embodiments, the CD2 binding molecule is administered in combination with an interleukine-1 beta (IL-1β) inhibitor.

In some embodiments, the IL-1β inhibitor is canakinumab. Canakinumab is also known as ACZ885 or ILARIS®. Canakinumab is a human monoclonal IgG1/K antibody that neutralizes the bioactivity of human IL-1β. Canakinumab is disclosed, e.g., in WO 2002/16436, U.S. Pat. No. 7,446,175, and EP 1313769.

In some embodiments, the CD2 binding molecule is administered in combination with a CD32B inhibitor. In some embodiments, the CD32B inhibitor is an anti-CD32B antibody molecule. Exemplary anti-CD32B antibody molecules are disclosed in U.S. Pat. Nos. 8,187,593, 8,778,339, 8,802,089, US20060073142, US20170198040, and US20130251706.

In some embodiments, the CD2 binding molecule is administered in combination with one of the compounds listed in Table 19.
TABLE 19
| Compound Designation | Generic Name Tradename | Compound Structure | Patents/Patent Application Publications |
|---|---|---|---|
| A1 | Sotrastaurin | 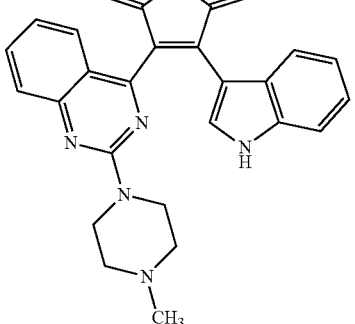 | EP 1682103<br>US 2007/142401<br>WO 2005/039549 |
| A2 | Nilotinib HCl monohydrate TASIGNA ® | 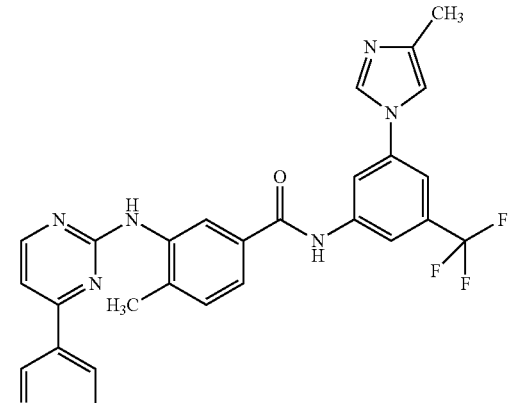<br>HCl • H₂O | WO 2004/005281<br>U.S. Pat. No. 7,169,791 |
| A3 | | 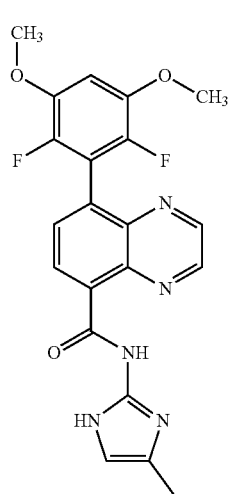 | WO 2009/141386<br>US 2010/0105667 |

TABLE 19-continued

| Compound Designation | Generic Name Tradename | Compound Structure | Patents/Patent Application Publications |
|---|---|---|---|
| A4 | | 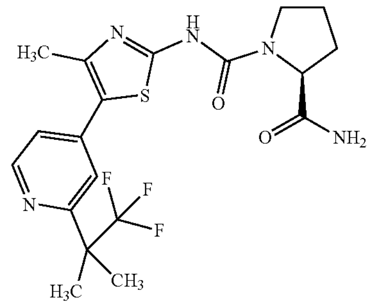 [SMILES: Cc1nc(NC(=O)N2CCC[C@H]2C(N)=O)sc1-c1ccnc(C(C)(C)C(F)(F)F)c1] | WO 2010/029082 |
| A5 | | 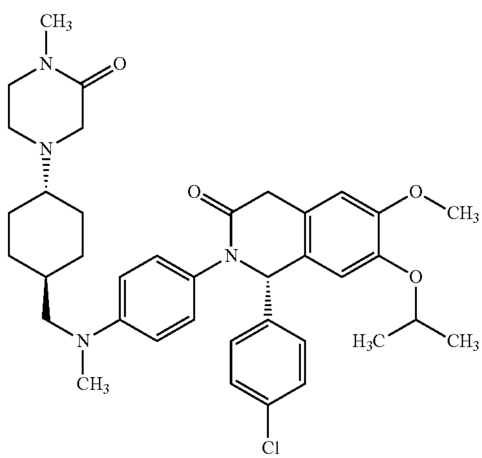 [SMILES: COc1cc2c(cc1OC(C)C)[C@H](c1ccc(Cl)cc1)N(c1ccc(N(C)C[C@H]3CC[C@H](N4CCN(C)C(=O)C4)CC3)cc1)C(=O)C2] | WO 2011/076786 |
| A6 | Deferasirox EXJADE ® | 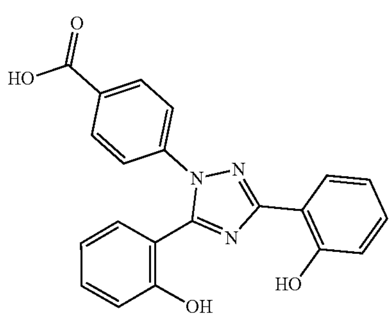 [SMILES: O=C(O)c1ccc(-n2nc(-c3ccccc3O)nc2-c2ccccc2O)cc1] | WO 1997/049395 |
| A7 | Letrozole FEMARA ® | 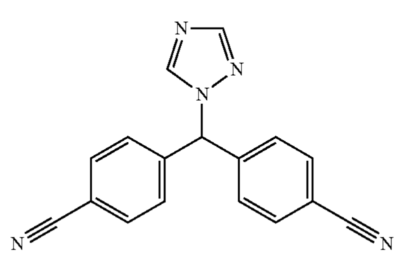 [SMILES: N#Cc1ccc(C(c2ccc(C#N)cc2)n2cncn2)cc1] | U.S. Pat. No. 4,978,672 |

TABLE 19-continued

| Compound Designation | Generic Name Tradename | Compound Structure | Patents/Patent Application Publications |
|---|---|---|---|
| A8 | | 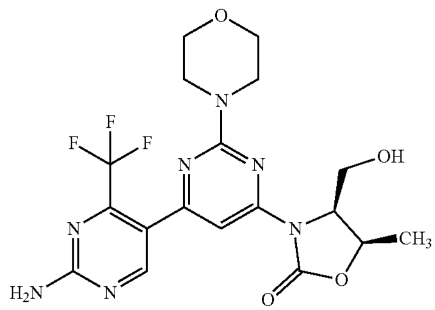 [SMILES: C[C@H]1OC(=O)N(c2cc(-c3cnc(N)nc3C(F)(F)F)nc(N3CCOCC3)n2)[C@H]1CO] | WO 2013/124826<br>US 2013/0225574 |
| A9 | | 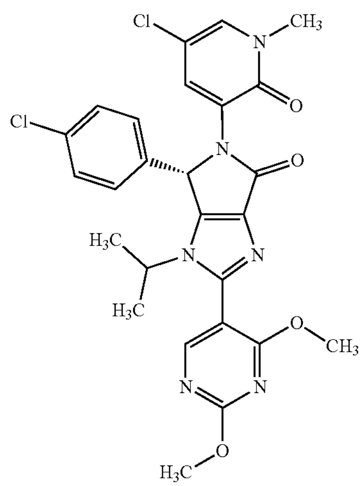 [SMILES: COc1ncc(-c2nc3c(n2C(C)C)[C@H](c2ccc(Cl)cc2)N(c2cc(Cl)cn(C)c2=O)C3=O)c(OC)n1] | WO 2013/111105 |
| A10 | BLZ945 | 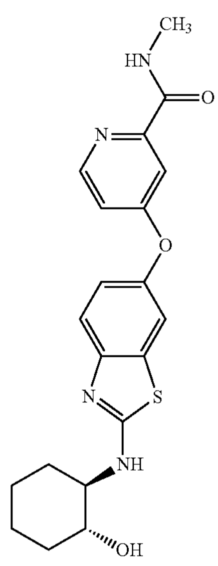 [SMILES: CNC(=O)c1cc(Oc2ccc3nc(N[C@@H]4CCCC[C@H]4O)sc3c2)ccn1] | WO 2007/121484 |

TABLE 19-continued
| Compound Designation | Generic Name Tradename | Compound Structure | Patents/Patent Application Publications |
|---|---|---|---|
| A11 | Imatinib mesylate GLEEVEC ® | 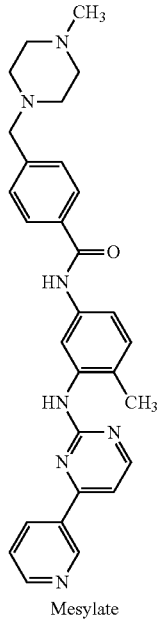 [SMILES: Cc1ccc(NC(=O)c2ccc(CN3CCN(C)CC3)cc2)cc1Nc1nccc(-c2cccnc2)n1]<br>Mesylate | WO 1999/003854 |
| A12 | Capmatinib | 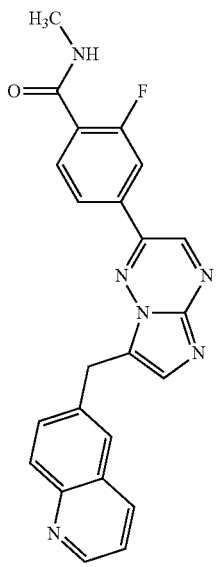<br>Dihydrochloric salt | EP 2099447<br>U.S. Pat. No. 7,767,675<br>U.S. Pat. No. 8,420,645 |

TABLE 19-continued

| Compound Designation | Generic Name Tradename | Compound Structure | Patents/Patent Application Publications |
|---|---|---|---|
| A13 | Ruxolitinib Phosphate JAKAFI ® | H₃PO₄ | WO 2007/070514<br>EP 2474545<br>U.S. Pat. No. 7,598,257<br>WO 2014/018632 |
| A14 | Panobinostat | 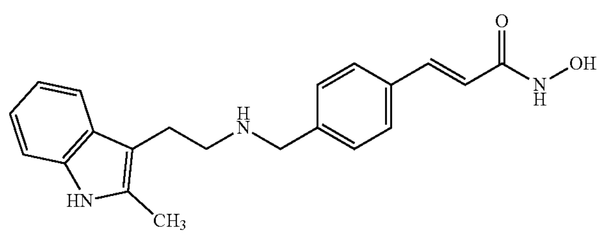 | WO 2014/072493<br>WO 2002/022577<br>EP 1870399 |
| A15 | Osilodrostat | 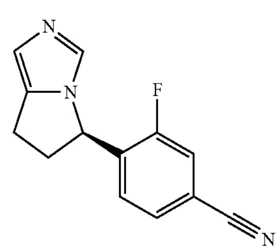 | WO 2007/024945 |
| A16 | | 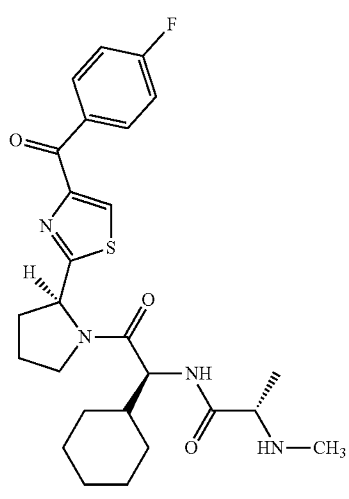 | WO 2008/016893<br>EP 2051990<br>U.S. Pat. No. 8,546,336 |

TABLE 19-continued

| Compound Designation | Generic Name Tradename | Compound Structure | Patents/Patent Application Publications |
|---|---|---|---|
| A17 | ceritinib ZYKADIA™ | 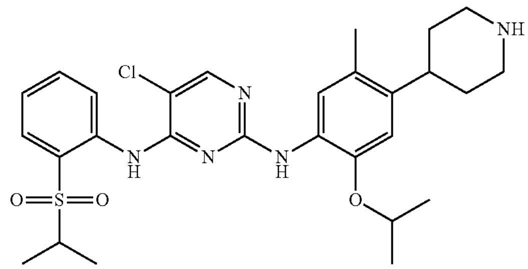 [SMILES: Cc1cc(Nc2ncc(Cl)c(Nc3ccccc3S(=O)(=O)C(C)C)n2)c(OC(C)C)cc1C1CCNCC1] | WO 2008/073687 U.S. Pat. No. 8,039,479 |
| A18 | Ribociclib KISQALI® | 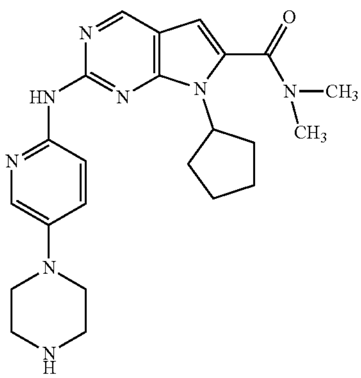 [SMILES: CN(C)C(=O)c1cc2cnc(Nc3ccc(N4CCNCC4)cn3)nc2n1C1CCCC1] | U.S. Pat. No. 8,415,355 U.S. Pat. No. 8,685,980 |
| A19 | | 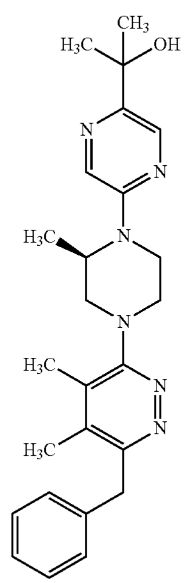 [SMILES: Cc1c(Cc2ccccc2)nnc(N2CCN(c3cnc(C(C)(C)O)cn3)[C@H](C)C2)c1C] | WO 2010/007120 |
| A20 | | Human monoclonal antibody to PRLR | U.S. Pat. No. 7,867,493 |

TABLE 19-continued

| Compound Designation | Generic Name Tradename | Compound Structure | Patents/Patent Application Publications |
|---|---|---|---|
| A21 | | 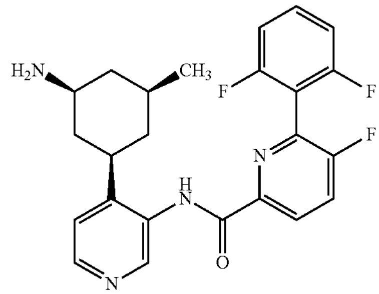 [SMILES: C[C@@H]1C[C@H](N)C[C@H](c2ccncc2NC(=O)c2ccc(F)c(-c3c(F)cccc3F)n2)C1] | WO 2010/026124<br>EP 2344474<br>US 2010/0056576<br>WO2008/106692 |
| A22 | WNT974 | 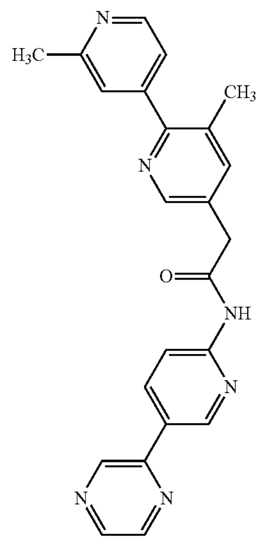 | WO 2010/101849 |
| A23 | | 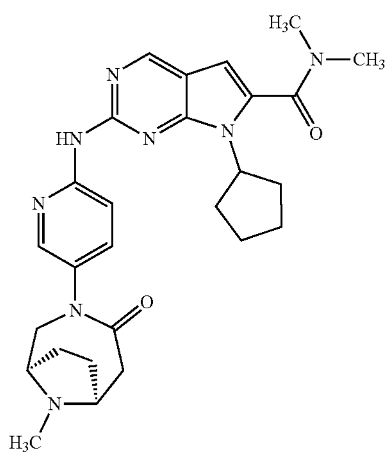 [SMILES: CN(C)C(=O)c1cc2cnc(Nc3ccc(N4C[C@H]5CC[C@@H](CC4=O)N5C)cn3)nc2n1C1CCCC1] | WO 2011/101409 |
| A24 | | Human monoclonal antibody to HER3,, e.g., LJM716 | WO 2012/022814<br>EP 2606070<br>U.S. Pat. No. 8,735,551 |
| A25 | | Antibody Drug Conjugate (ADC) | WO 2014/160160, e.g., Ab: 12425 (see Table 1, paragraph [00191])<br>Linker: SMCC (see paragraph [00117]<br>Payload: DM1 (see paragraph [00111]<br>See also Claim 29 |

TABLE 19-continued
| Compound Designation | Generic Name Tradename | Compound Structure | Patents/Patent Application Publications |
|---|---|---|---|
| A26 | | Monoclonal antibody or Fab to M-CSF, e.g., MCS110 | WO 2004/045532 |
| A27 | Midostaurin | 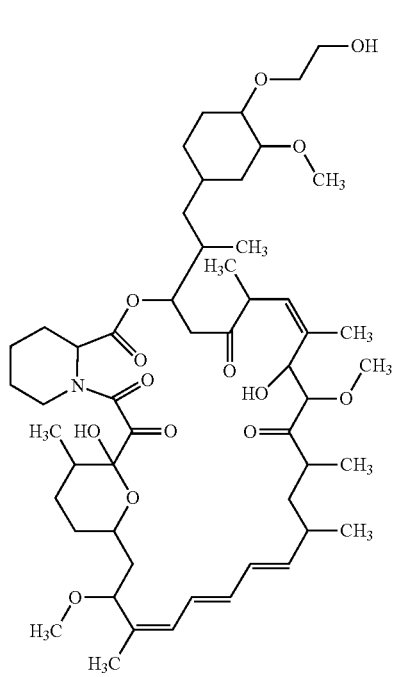 | WO 2003/037347<br>EP 1441737<br>US 2012/252785 |
| A28 | Everolimus<br>AFINITOR ® | 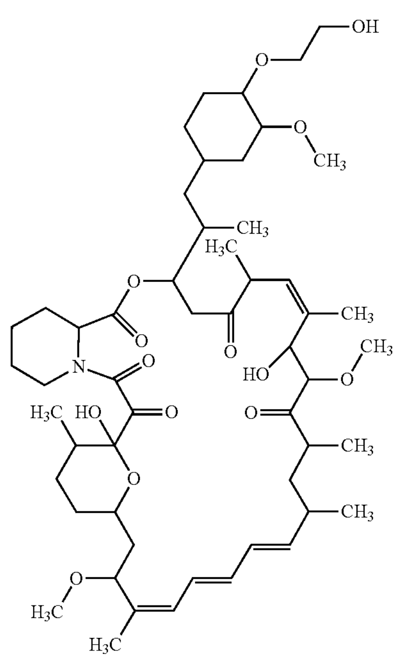 [SMILES: COC1CC2CCC(C)C(O)(O2)C(=O)C(=O)N2CCCCC2C(=O)OC(C(C)CC2CCC(OCCO)C(OC)C2)CC(=O)C(C)/C=C(/C)C(O)C(OC)C(=O)C(C)CC(C)/C=C/C=C/C=C\1C] | WO 2014/085318 |

TABLE 19-continued

| Compound Designation | Generic Name Tradename | Compound Structure | Patents/Patent Application Publications |
|---|---|---|---|
| A29 | | 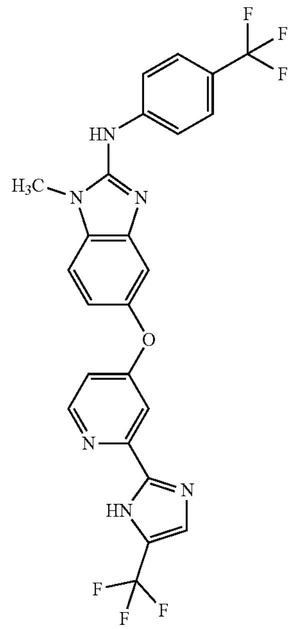 [SMILES: Cn1c(Nc2ccc(C(F)(F)F)cc2)nc2cc(Oc3ccnc(-c4ncc(C(F)(F)F)[nH]4)c3)ccc21] | WO 2007/030377<br>U.S. Pat. No. 7,482,367 |
| A30 | Pasireotide diaspartate SIGNIFOR® | 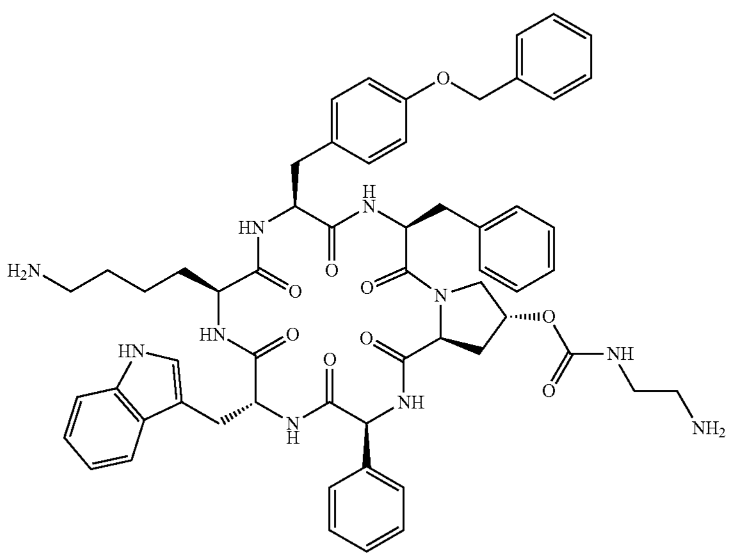 [SMILES: NCCCC[C@@H]1NC(=O)[C@@H](Cc2c[nH]c3ccccc23)NC(=O)[C@H](c2ccccc2)NC(=O)[C@@H]2C[C@@H](OC(=O)NCCN)CN2C(=O)[C@H](Cc2ccccc2)NC(=O)[C@H](Cc2ccc(OCc3ccccc3)cc2)NC1=O] | U.S. Pat. No. 7,473,761 |
| A31 | | 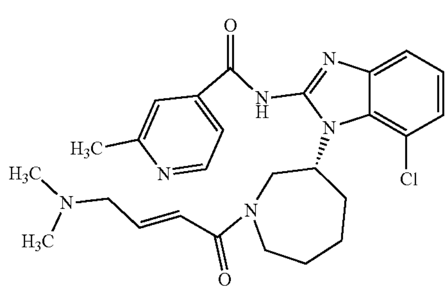 [SMILES: Cc1cc(C(=O)Nc2nc3cccc(Cl)c3n2[C@@H]2CCCCN(C(=O)/C=C/CN(C)C)C2)ccn1] | WO 2013/184757 |

TABLE 19-continued

| Compound Designation | Generic Name Tradename | Compound Structure | Patents/Patent Application Publications |
|---|---|---|---|
| A32 | | 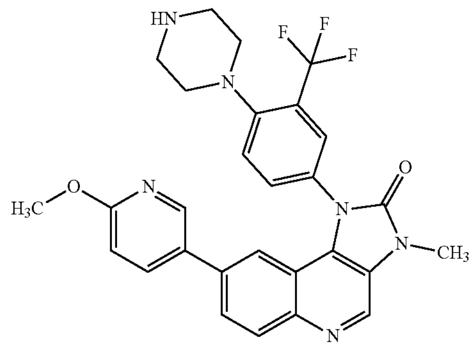 | WO 2006/122806 |
| A33 | | 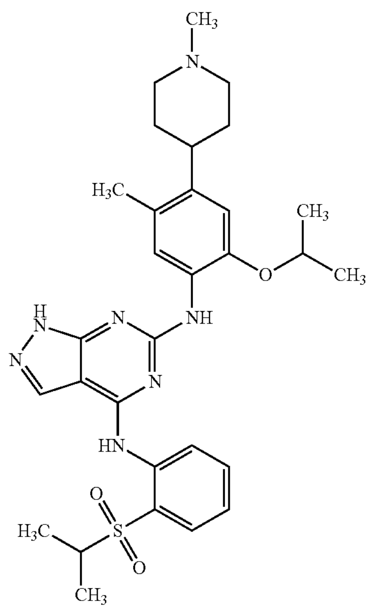 [SMILES: Cc1cc(Nc2nc(Nc3ccccc3S(=O)(=O)C(C)C)c3cn[nH]c3n2)c(OC(C)C)cc1C1CCN(C)CC1] | WO 2008/073687<br>U.S. Pat. No. 8,372,858 |
| A34 | | 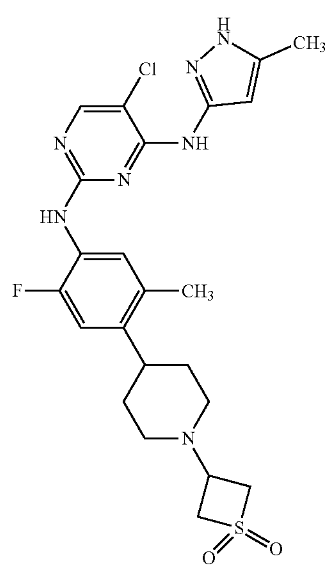 [SMILES: Cc1cc(Nc2nc(Nc3cc(C)c(C4CCN(C5CS(=O)(=O)C5)CC4)cc3F)ncc2Cl)n[nH]1] | WO 2010/002655<br>U.S. Pat. No. 8,519,129 |

TABLE 19-continued
| Compound Designation | Generic Name Tradename | Compound Structure | Patents/Patent Application Publications |
|---|---|---|---|
| A35 | | 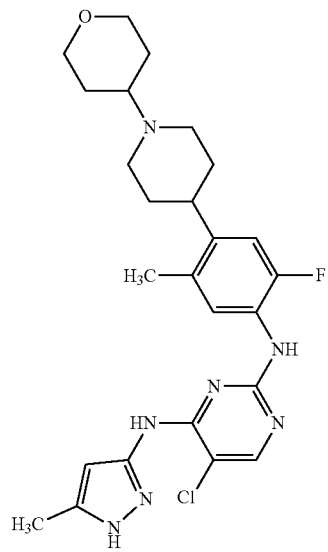 [SMILES: Cc1cc(Nc2nc(Nc3cc(C)c(C4CCN(C5CCOCC5)CC4)cc3F)ncc2Cl)n[nH]1] | WO 2010/002655 U.S. Pat. No. 8,519,129 |
| A36 | | 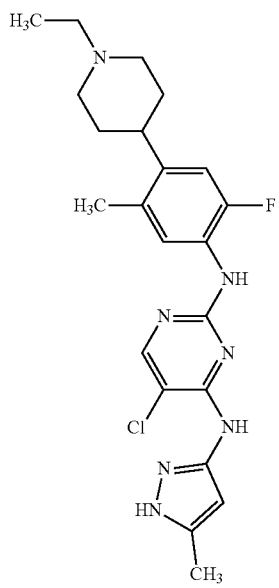 [SMILES: CCN1CCC(c2cc(F)c(Nc3ncc(Cl)c(Nc4cc(C)[nH]n4)n3)cc2C)CC1] | WO 2010/002655 |

TABLE 19-continued

| Compound Designation | Generic Name Tradename | Compound Structure | Patents/Patent Application Publications |
|---|---|---|---|
| A37 | Valspodar AMDRAY ™ | [cyclic peptide structure] | EP 296122 |
| A38 | Vatalanib succinate | [phthalazine structure] succinate | WO 98/35958 |
| A39 | | IDH inhibitor, e.g., IDH305 | WO2014/141104 |
| A40 | Asciminib | BCR-ABL inhibitor [structure] | WO2013/171639 W02013/171640 WO2013/171641 WO2013/171642 |
| A41 | | cRAF inhibitor | WO2014/151616 |
| A42 | | ERK1/2 ATP competitive inhibitor | WO2015/066188 |

TABLE 19-continued

| Compound Designation | Generic Name Tradename | Compound Structure | Patents/Patent Application Publications |
|---|---|---|---|
| A43 | | 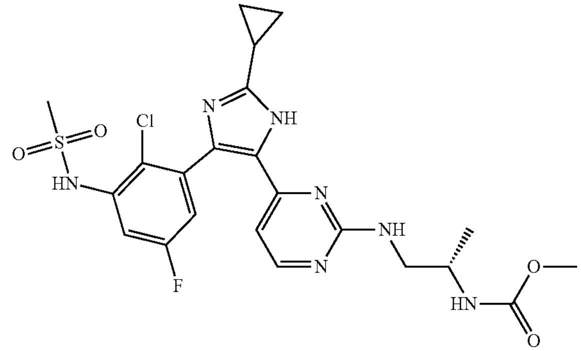 [SMILES: COC(=O)N[C@@H](C)CNc1nccc(-c2[nH]c(C3CC3)nc2-c2cc(F)cc(NS(C)(=O)=O)c2Cl)n1] | WO2011/023773 |
| A44 | | 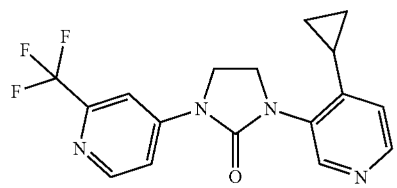 [SMILES: O=C1N(c2ccnc(C(F)(F)F)c2)CCN1c1cnccc1C1CC1] | WO2012/149413 |
| A45 | SHP099 | 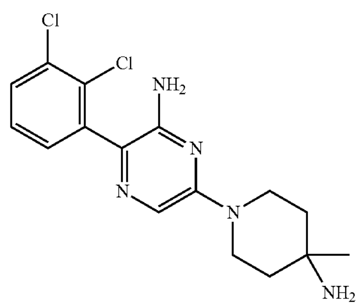 [SMILES: CC1(N)CCN(c2cnc(-c3cccc(Cl)c3Cl)c(N)n2)CC1] | WO2015/107493 |
| A46 | | SHP2 inhibitor of Formula I | WO2015/107495 |
| A47 | | 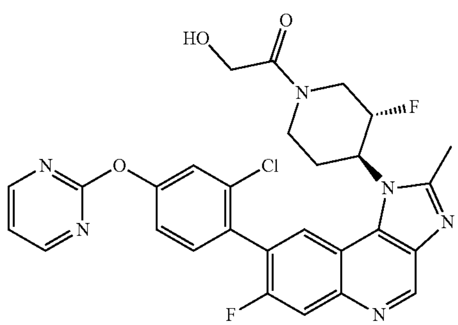 [SMILES: Cc1nc2cnc3cc(F)c(-c4ccc(Oc5ncccn5)cc4Cl)cc3c2n1[C@H]1CCN(C(=O)CO)C[C@@H]1F] | WO2015/022662 |
| A48 | | 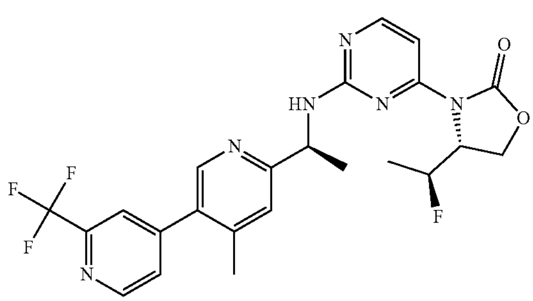 [SMILES: Cc1cc([C@H](C)Nc2nccc(N3C(=O)OC[C@@H]3[C@H](C)F)n2)ncc1-c1ccnc(C(F)(F)F)c1] | WO2014/141104 |

TABLE 19-continued
| Compound Designation | Generic Name Tradename | Compound Structure | Patents/Patent Application Publications |
|---|---|---|---|
| A49 | | <br>or a choline salt thereof | WO2010/015613<br>WO2013030803<br>U.S. Pat. No. 7,989,497, |
| A50 | | A2A receptor antagonist of Formula (I) | WO 2017/025918<br>WO2011/121418<br>U.S. Pat. No. 8,796,284 |
| A51 | | 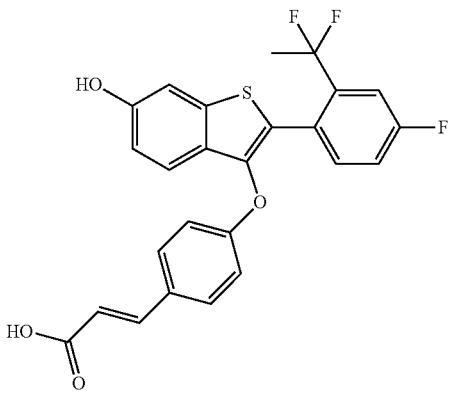 [SMILES: CC(F)(F)c1cc(F)ccc1-c1sc2cc(O)ccc2c1Oc1ccc(/C=C/C(=O)O)cc1] | WO2014/130310 |
| A52 | trametinib | 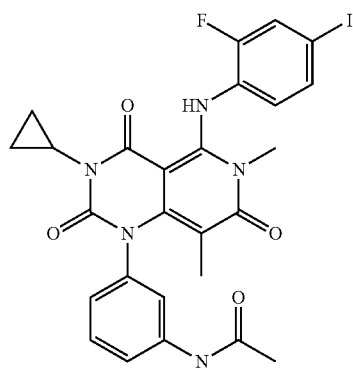 | WO2005/121142<br>U.S. Pat. No. 7,378,423 |
| A53 | dabrafenib | 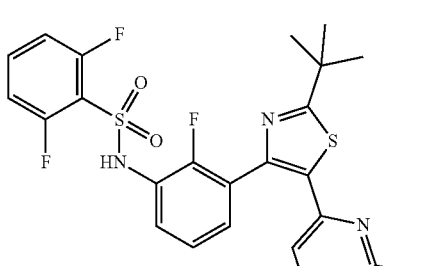 | WO 2009/137391<br>U.S. Pat. No. 7,994,185 |

TABLE 19-continued

| Compound Designation | Generic Name Tradename | Compound Structure | Patents/Patent Application Publications |
|---|---|---|---|
| A54 | octreotide | 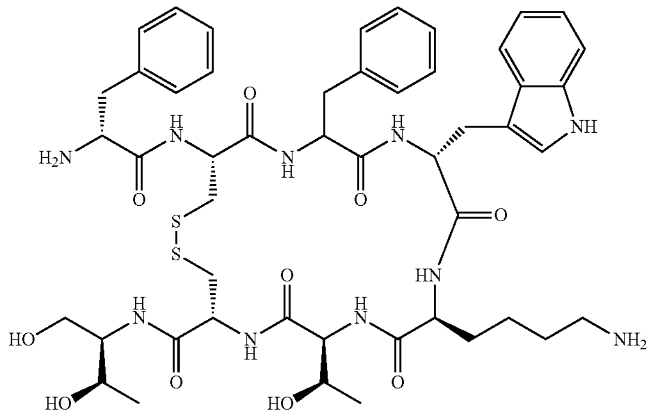 [SMILES: C[C@@H](O)[C@@H]1NC(=O)[C@H](CCCCN)NC(=O)[C@@H](Cc2c[nH]c3ccccc23)NC(=O)C(Cc2ccccc2)NC(=O)[C@@H](NC(=O)[C@H](N)Cc2ccccc2)CSSC[C@@H](C(=O)N[C@H](CO)[C@@H](C)O)NC1=O] | U.S. Pat. No. 4,395,403 EP 0 029 579 |
| A55 | | 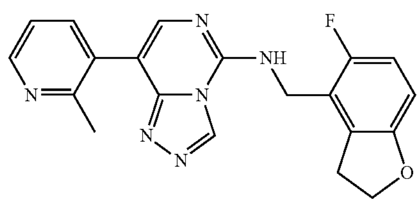 [SMILES: Cc1ncccc1-c1cnc(NCc2c(F)ccc3c2CCO3)n2cnnc12] | WO 2016/103155 U.S. Pat. No. 9580437 EP 3237418 |
| A56 | | 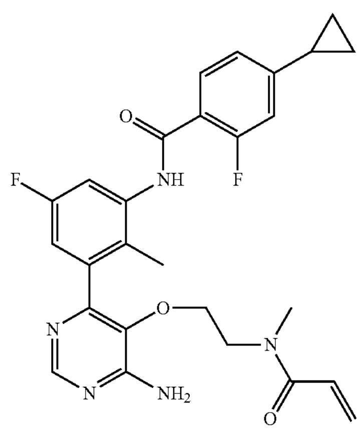 [SMILES: C=CC(=O)N(C)CCOc1c(N)ncnc1-c1cc(F)cc(NC(=O)c2ccc(C3CC3)cc2F)c1C] | U.S. Pat. No. 9,512,084 WO/2015/079417 |
| A57 | | 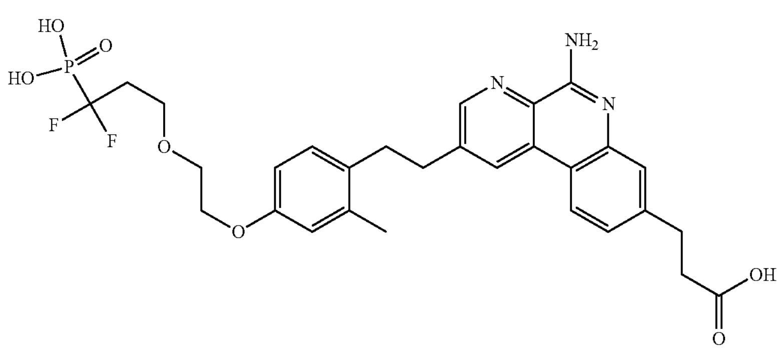 [SMILES: Cc1cc(OCCOCCC(F)(F)P(=O)(O)O)ccc1CCc1cnc2c(N)nc3cc(CCC(=O)O)ccc3c2c1] | WO2011/049677 |

In some embodiments, a CD2 binding molecule is administered in combination with one or more of NIZ985, a GITR agonist such as GWN323, PTK787, MBG453, mAb12425, CLR457, BGT226, BYL719, AMN107, ABL001, IDH305/ LQS305, LJM716, MCS110, WNT974/LGK974, BLZ945, NIR178, QBM076, MBG453, CGS-20267, LHS534, LKG960, LDM099/SHP099, TN0155, LCL161, MAP855/ LQN716, RAD001, LEJ511, LDK378, LOU064, LSZ102, LEQ506, RAF265/CHIR265, canakinumab, gevokizumab, Anakinra, Rilonacept, CGS-20267, PSC833, GGP-57148B, CGM097, HDM201, LBH589, PKC412, LHC165, MAK683, INC280, INC424, LJE704, LAG525, and NIS793.

In some embodiments, the CD2 binding molecule is administered in combination with a standard treatment.

Standard treatment for multiple myeloma and associated diseases includes chemotherapy, stem cell transplant (autologous or allogeneic), radiation therapy, and other drug therapies. Frequently used anti-myeloma drugs include alkylating agents (e.g., bendamustine, cyclophosphamide and melphalan), proteasome inhibitors (e.g., bortezomib), corticosteroids (e.g., dexamethasone and prednisone), and immunomodulators (e.g., thalidomide and lenalidomide or Revlimid®), or any combination thereof. Biphosphonate drugs are also frequently administered in combination with the standard anti-MM treatments to prevent bone loss. Patients older than 65-70 years of age are unlikely candidates for stem cell transplant. In some cases, double-autologous stem cell transplants are options for patients less than 60 years of age with suboptimal response to the first transplant. The compositions and methods of the present disclosure can be administered in combination with any of the currently prescribed treatments for multiple myeloma.

Hodgkin's lymphoma is commonly treated with radiation therapy, chemotherapy, or hematopoietic stem cell transplantation. The most common therapy for non-Hodgkin's lymphoma is R-CHOP, which consists of four different chemotherapies (cyclophosphamide, doxorubicin, vincristine, and prenisolone) and rituximab (Rituxan®). Other therapies commonly used to treat NHL include other chemotherapeutic agents, radiation therapy, stem cell transplantation (autologous or allogeneic bone marrow transplantation), or biological therapy, such as immunotherapy. Other examples of biological therapeutic agents include, but are not limited to, rituximab (Rituxan®), tositumomab (Bexxar®), epratuzumab (LymphoCide®), and alemtuzumab (MabCampath®). The compositions and methods of the present disclosure can be administered in combination with any of the currently prescribed treatments for Hodgkin's lymphoma or non-Hodgkin's lymphoma.

Standard treatment for WM consists of chemotherapy, specifically with rituximab (Rituxan®). Other chemotherapeutic drugs can be used in combination, such as chlorambucil (Leukeran®), cyclophosphamide (Neosar®), fludarabine (Fludara®), cladribine (Leustatin®), vincristine, and/or thalidomide. Corticosteriods, such as prednisone, can also be administered in combination with the chemotherapy. Plasmapheresis, or plasma exchange, is commonly used throughout treatment of the patient to alleviate some symptoms by removing the paraprotein from the blood. In some cases, stem cell transplantation is an option for some patients.

The CD2 binding molecules of the disclosure can be administered in combination with an agent which reduces or ameliorates a side effect associated with the administration of such binding molecules, including MBMs that bind to both CD19 and CD3. Side effects associated with the administration of MBMs that bind to both CD19 and CD3 can include, but are not limited to, cytokine release syndrome ("CRS") and hemophagocytic lymphohistiocytosis (HLH), also termed Macrophage Activation Syndrome (MAS). Symptoms of CRS can include high fevers, nausea, transient hypotension, hypoxia, and the like. CRS can include clinical constitutional signs and symptoms such as fever, fatigue, anorexia, myalgias, arthalgias, nausea, vomiting, and headache. CRS can include clinical skin signs and symptoms such as rash. CRS can include clinical gastrointestinal signs and symptoms such as nausea, vomiting and diarrhea. CRS can include clinical respiratory signs and symptoms such as tachypnea and hypoxemia. CRS can include clinical cardiovascular signs and symptoms such as tachycardia, widened pulse pressure, hypotension, increased cardiac output (early) and potentially diminished cardiac output (late). CRS can include clinical coagulation signs and symptoms such as elevated d-dimer, hypofibrinogenemia with or without bleeding. CRS can include clinical renal signs and symptoms such as azotemia. CRS can include clinical hepatic signs and symptoms such as transaminitis and hyperbilirubinemia. CRS can include clinical neurologic signs and symptoms such as headache, mental status changes, confusion, delirium, word finding difficulty or frank aphasia, hallucinations, tremor, dymetria, altered gait, and seizures.

Accordingly, the methods described herein can comprise administering a MBM that binds to both CD19 and CD3 to a subject and further administering one or more agents to manage elevated levels of a soluble factor resulting from treatment with the MBM. In one embodiment, the soluble factor elevated in the subject is one or more of IFN-γ, TNFα, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to, a steroid (e.g., corticosteroid), an inhibitor of TNFα, and inhibitor of IL-1R, and an inhibitor of IL-6. An example of a TNFα inhibitor is an anti-TNFα antibody molecule such as, infliximab, adalimumab, certolizumab pegol, and golimumab. Another example of a TNFα inhibitor is a fusion protein such as entanercept. Small molecule inhibitor of TNFα include, but are not limited to, xanthine derivatives (e.g. pentoxifylline) and bupropion. An example of an IL-6 inhibitor is an anti-IL-6 antibody molecule such as tocilizumab (toc), sarilumab, elsilimomab, ONTO 328, ALD518/BMS-945429, ONTO 136, CPSI-2364, CDP6038, VX30, ARGX-109, FE301, and FM101. In one embodiment, the anti-IL-6 antibody molecule is tocilizumab. An example of an IL-1R based inhibitor is anakinra.

In some embodiment, the subject is administered a corticosteroid, such as, e.g., methylprednisolone, hydrocortisone, among others. In some embodiments, the subject is administered a corticosteroid, e.g., methylprednisolone, hydrocortisone, in combination with Benadryl and Tylenol prior to the administration of a CD2 binding molecule, e.g., a MBM that binds CD2, CD3 and a TAA.

In some embodiments, the subject is administered a vasopressor, such as, e.g., norepinephrine, dopamine, phenylephrine, epinephrine, vasopressin, or any combination thereof.

In an embodiment, the subject can be administered an antipyretic agent. In an embodiment, the subject can be administered an analgesic agent.

8. EXAMPLES

Examples 1-15 below correspond to Examples 1-15, respectively, of U.S. provisional application Nos. 62/850,918 and 62/854,715 (the "priority applications"). FIGS. 4-13, discussed in Examples 2 to 11 below, correspond to FIGS. 4-13 of the priority applications. The data shown in FIGS. 4-13 was generated with the bispecific and trispecific constructs described in Example 1 of the priority applications and described in Example 1 below. The original nomenclature shown in FIGS. 4-13 of the priority applications has been replaced with simplified nomenclature in the present disclosure. The correspondence between the original and simplified nomenclature is shown in Table B.

TABLE B

| FIG. of the priority applications | FIG. of the present disclosure | Original nomenclature | Simplified nomenclature |
|---|---|---|---|
| 4 | 4A-4B | αCD19(NEG218)-αCD3(16 nM) | CD3hi BSP2 - 2 arm |
|   |   | αCD19(NEG258)-αCD3(16 nM) | CD3hi BSP1 - 2 arm |
|   |   | αgH-αCD3(16 nM) | control |
| 5 | 5A-5B | αgH-αCD3(16 nM) | control |
|   |   | αCD19(NEG218)-αCD3(16 nM) | CD3hi BSP2 - 2 arm |
|   |   | αCD19(NEG258)-αCD3(16 nM) | CD3hi BSP1 - 2 arm |
| 6B | 6C-6F | αCD19(NEG258)-αCD3(16 nM)-αLyzm | CD3hi TSP1L |
|   |   | αCD19(NEG258)-αCD3(16 nM)-αCD58IgV | CD3hi TSP1 |
|   |   | αCD19(NEG258)-αCD3(30 nM)-αCD58IgV | CD3med TSP1 |
|   |   | αCD19(NEG258)-αCD3(48 nM)-αCD58IgV | CD3lo TSP1 |
|   |   | αCD19(NEG218)-αCD3(16 nM) | CD3hi BSP2 - 2 arm |
|   |   | αCD19(NEG218)-αCD3(16 nM)-αCD58IgV | CD3hi TSP2 |
| 7 | 7A | αCD19(NEG218)-αCD3-CD58(IgV) | CD3hi TSP2 |
|   | 7B | αCD19(NEG258)-αCD3-αCD58(IgV) | CD3hi TSP1 |
| 8A | 8A | αCD19(NEG258)-αCD3(16 nM)-α-Lyzm | CD3hi TSP1L |
|   |   | αCD19(NEG258)-αCD3(16 nM)-αCD58IgV | CD3hi TSP1 |
| 8B | 8C-8E | αCD19(NEG258)-αCD3(16 nM)-αLyzm | CD3hi TSP1L |
|   | 8F-8H | αCD19(NEG258)-αCD3(16 nM)-αCD58IgV | CD3hi TSP1 |
| 9A-9B | 9A-9P | αCD19(NEG218)-αCD3-CD58IgV | CD3hi TSP2 |
|   |   | αCD19(NEG258)-αCD3-CD58IgV | CD3hi TSP1 |
| 10A-10B | 10A-10P | αCD19(NEG258)-αCD3(48 nM)-CD58IgV | CD3lo TSP1 |
|   |   | αCD19(NEG258)-αCD3(30 nM)-CD58IgV | CD3med TSP1 |
|   |   | αCD19(NEG258)-αCD3(16 nM)-CD58IgV | CD3hi TSP1 |
| 11A-11B | 11A-11L | αCD19(NEG258)-αCD3-αLyzm | CD3hi TSP1L |
|   |   | αCD19(NEG258)-αCD3-CD58IgV | CD3hi TSP1 |
| 12 | 12A-12C | αCD19(NEG258)-αCD3-CD58IgV | CD3hi TSP1 |
|   |   | αCD19(NEG218)-αCD3-CD58IgV | CD3hi TSP2 |
| 13 | 13A-13C | αCD19(NEG218)-αCD3-CD58IgV | CD3hi TSP2 |
|   |   | αCD19(NEG258)-αCD3-CD58IgV | CD3hi TSP1 |

8.1. Example 1: Production of Anti-CD3-Anti-CD19 IgG1 Bispecific and Trispecific Binding Molecules in Knob-into-Holes Format BBMs having a CD3 ABM and a CD19 ABM (shown schematically in FIG. 3A), and TBMs having a CD3 ABM, a CD19 ABM, and a CD2 ABM (shown schematically in FIG. 3B) were produced in a knob-into-hole (KIH) format. Each BBM and TBM of this Example comprises a first half antibody (shown schematically as the left half of each construct shown in FIGS. 3A-3B) and a second half antibody (shown schematically as the right half of each construct shown in FIGS. 3A-3B).

8.1.1. Materials and Methods 8.1.1.1. Plasmids Encoding BBMs and TBMs

Plasmids for all constructs were synthesized and codon optimized for expression in mammalian cells.

For each bispecific construct, three plasmids were synthesized. A first plasmid encoding an anti-CD19 heavy chain was synthesized as a fusion comprising (in the N-terminal to C-terminal direction) (i) an anti-CD19 VH domain and (ii) a constant hIgG1 domain containing T366S, L368A, and Y407V mutations for a hole to facilitate heterodimerization as well as silencing mutations. A second plasmid encoding a light chain was synthesized as a fusion comprising (in the N-terminal to C-terminal direction) (i) an anti-CD19 VL domain and (ii) a constant human kappa sequence. The proteins encoded by the first and second plasmids form the first half antibody. A third plasmid encoding the second half antibody was synthesized as a fusion comprising (in the N-terminal to C-terminal direction) (i) an anti-CD3 single chain variable fragment (having the VH and VL domains of an anti-CD3 antibody designated as CD3hi (as defined in the following paragraph)), (ii) a linker, and (iii) a constant hIgG1 domain containing a T366W mutation for a knob to facilitate heterodimerization as well as silencing mutations.

For each trispecific construct, three plasmids were synthesized. A first plasmid encoding an anti-CD19 heavy chain was synthesized as a fusion comprising (in the N-terminal to C-terminal direction) (i) an anti-CD19 VH domain fused to a constant hIgG1 CH1 domain, (ii) a linker, (iii) an anti-CD3 scFv with VH and VL domains of an anti-CD3 antibody having high, medium, or low affinity to CD3 (in relative terms), and referred to herein as CD3hi, CD3med or CD3lo (from anti-CD3 antibodies having an affinity to CD3 of 16 nM, 30 nM, or 48 nm, respectively, as measured by Biacore), (iv) a second linker, and (v) an hIgG1 Fc domain containing T366S, L368A, and Y407V mutations for a hole to facilitate heterodimerization as well as silencing mutations. It should be understood that with respect to the mentioned Biacore affinity values and relative terms in the construct names, these are used merely for identification purposes and are not intended to represent absolute affinity values. A second plasmid encoding a light chain was synthesized as a fusion comprising (in the N-terminal to C-terminal direction) (i) an anti-CD19 VL domain and (ii) a constant human kappa sequence. The proteins encoded by the first and second plasmids form the first half antibody. A third plasmid encoding the second half antibody was synthesized as a fusion comprising (in the N-terminal to C-terminal direction) (i) the IgV domain of CD58 (CD58-6) and (ii) a constant hIgG1 domain containing a T366W mutation for a knob to facilitate heterodimerization as well as silencing mutations.

Control constructs corresponding to the CD3hi TSP1 (which was originally referred to as CD19_NEG258_CD3_16 nM-CD58 or CD19_NEG258_CD3_16 nM-CD58 Trispecific and has a NEG258-based CD19 binding arm) and CD3hi TSP2 (which was originally referred to as CD19_NEG218_CD3_16 nM-CD58 or CD19_NEG218_CD3_16 nM-CD58 Trispecific and has a NEG218-based CD19 binding arm) trispecific constructs were produced in which the CD2 ABM was replaced with a Vhh against hen egg lysozyme (such control constructs originally referred to as CD19_NEG258_CD3_16 nM-lysozyme Trispecific and CD19_NEG218_CD3_16 nM-lysozyme Trispecific, respectively, and having the simplified names CD3hi TSP1L and CD3hi TSP2L, respectively).

Amino acid sequences for components of the constructs are shown in Table 20A (without Fc sequences) and Table 20-B (with Fc sequences).

TABLE 20-A

Amino acid sequences

| Simplified Construct Name | Original Construct Name | Chain Description | Amino Acid Sequence | SEQ ID NO: |
|---|---|---|---|---|
| CD3hi TSP1 | CD19_NEG258_CD3_16 nM-Trispecific | First Half Antibody Heavy Chain (Fc sequence not shown) | QVQLVQSGAEVKKPGASVKVSCKASGYTFTTY WIQWVRQAPGQRLEWMGAVYPGDADTRYTQK FQGRVTLTADRSASTAYMELSSLRSEDTAVYYC GRDAGLEYYALDYWGQGTLVTVSSASTKGPSV FPLAPSSKSTSGGTAALGCLVKDYFPEPVTVSW NSGALTSGVHTFPAVLQSSGLYSLSSVVTVPSS SLGTQTYICNVNHKPSNTKVDKRVEPKSCGGG GSGGGGSEVQLVESGGGLVQPGGSLKLSCAA SGFTFNTYAMNWVRQASGKGLEWVGRIRSKY NNYATYYADSVKDRFTISRDDSKSTLYLQMNSL KTEDTAVYYCVRHGNFGNSYVSWFAYWGQGT LVTVSSGGGGSGGGGSGGGGSGGGGSQAVV TQEPSLTVSPGGTVTLTCRSSTGAVTTSNYAN WVQQKPGQAPRGLIGGTNKRAPWTPARFSGS LLGDKAALTLSGAQPEDEAEYFCALWYSNLWV FGGGTKLTVLGGGGS | 1006 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYANFPLYT FGQGTKLEIKRTVAAPSVFIFPPSDEQLKSGTAS VVCLLNNFYPREAKVQWKVDNALQSGNSQESV TEQDSKDSTYSLSSTLTLSKADYEKHKVYACEV THQGLSSPVTKSFNRGEC | 1007 |
| | | Second Half Antibody (Fc sequence not shown) | SQQIYGVVYGNVTFHVPSNVPLKEVLWKKQKD KVAELENSEFRAFSSFKNRNLDTVSGSLTIYNL TSSDEDEYEMESPNITDTMKFFLYVLESGGGGS | 1008 |
| CD3med TSP1 | CD19_NEG258_CD3_30 nM-CD58 Trispecific | First Half Antibody Heavy Chain (Fc sequence not shown) | QVQLVQSGAEVKKPGASVKVSCKASGYTFTTY WIQWVRQAPGQRLEWMAGAVYPGDADTRYTQK FQGRVTLTADRSASTAYMELSSLRSEDTAVYYC GRDAGLEYYALDYWGQGTLVTVSSASTKGPSV FPLAPSSKSTSGGTAALGCLVKDYFPEPVTVSW NSGALTSGVHTFPAVLQSSGLYSLSSVVTVPSS SLGTQTYICNVNHKPSNTKVDKRVEPKSCGGG GSGGGGSEVQLVESGGGLVQPGGSLKLSCAA SGFTFNTYAMNWVRQASGKGLEWVGRIRSKY NNYATYYADSVKDRFTISRDDSKNTAYLQMNSL KTEDTAVYYCVRHGNFGNSYVSWFAHWGQGT LVTVSSGGGGSGGGGSGGGGSGGGGSQAVV TQEPSLTVSPGGTVTLTCGSSTGAVTSSNYAN WVQQKPGQAPRGLIGGTNKRAPWTRARFSGS LLGGKAALTLSGAQPEDEAEYYCALWYSNLWV FGGGTKLTVLGGGGS | 1009 |

TABLE 20-A-continued

Amino acid sequences

| Simplified Construct Name | Original Construct Name | Chain Description | Amino Acid Sequence | SEQ ID NO: |
|---|---|---|---|---|
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYANFPLYT FGQGTKLEIKRTVAAPSVFIFPPSDEQLKSGTAS VVCLLNNFYPREAKVQWKVDNALQSGNSQESV TEQDSKDSTYSLSSTLTLSKADYEKHKVYACEV THQGLSSPVTKSFNRGEC | 1007 |
| | | Second Half Antibody (Fc sequence not shown) | SQQIYGVVYGNVTFHVPSNVPLKEVLWKKQKD KVAELENSEFRAFSSFKNRVYLDTVSGSLTIYNL TSSDEDEYEMESPNITDTMKFFLYVLESGGGGS | 1008 |
| CD3lo TSP1 | CD19_ NEG258_CD3_ 48 nM-CD58 Trispecific | First Half Antibody Heavy Chain (Fc sequence not shown) | QVQLVQSGAEVKKPGASVKVSCKASGYTFTTY WIQWVRQAPGQRLEWMGAVYPGDADTRYTQK FQGRVTLTADRSASTAYMELSSLRSEDTAVYYC GRDAGLEYYALDYWGQGTLVTVSSASTKGPSV FPLAPSSKSTSGGTAALGCLVKDYFPEPVTVSW NSGALTSGVHTFPAVLQSSGLYSLSSVVTVPSS SLGTQTYICNVNHKPSNTKVDKRVEPKSCGGG GSGGGGSEVQLVESGGGLVQPGGSLKLSCAA SGFTFNTYAMNWVRQASGKGLEWVGRIRSKY NNYATYYADSVKDRFTISRDDSKSTAYLQMNSL KTEDTAVYYCVRHGNFGNSYVSWFAYWGQGT LVTVSSGGGGSGGGGSGGGGSGGGGSQAVV TQEPSLTVSPGGTVTLTCRSSTGAVTTSNYAN WVQQKPGQAPRGLIGGTNKRAPWTPARFSGS LLGDKAALTLSGAQPEDEAEYFCALWYSNLWV FGGGTKLTVLGGGGS | 1010 |
| | | First Half Antibody Light Chain | EIVMTQSPATLSVSPGERATLSCRASQDVGTAV AWYQQKPGQAPTLLIYWASTRHTGIPARFSGS GSGTEFTLTISSLQSEDFAVYFCQQYANFPLYT FGQGTKLEIKRTVAAPSVFIFPPSDEQLKSGTAS VVCLLNNFYPREAKVQWKVDNALQSGNSQESV TEQDSKDSTYSLSSTLTLSKADYEKHKVYACEV THQGLSSPVTKSFNRGEC | 1007 |
| | | Second Half Antibody (Fc sequence not shown) | SQQIYGVVYGNVTFHVPSNVPLKEVLWKKQKD KVAELENSEFRAFSSFKNRVYLDTVSGSLTIYNL TSSDEDEYEMESPNITDTMKFFLYVLESGGGGS | 1008 |
| CD3hi TSP2 | CD19_ NEG218_CD3_ 16 nM-CD58 Trispedfic | First Half Antibody Heavy Chain (Fc sequence not shown) | EVQLVQSGAEVKKPGESLKISCKASGYSFTNY WMNWVRQMPGKGLEWMGMIHPSDSEIRLNQK FQGQVTLSVDKSIGTAYMQWSSLKASDTAMYY CSRWYYLSSPMDYWGQGTTVTVSSASTKGPS VFPLAPSSKSTSGGTAALGCLVKDYFPEPVTVS WNSGALTSGVHTFPAVLQSSGLYSLSSVVTVP SSSLGTQTYICNVNHKPSNTKVDKRVEPKSCG GGGSGGGGSEVQLVESGGGLVQPGGSLKLSC AASGFTFNTYAMNWVRQASGKGLEWVGRIRS KYNNYATYYADSVKDRFTISRDDSKSTLYLQMN SLKTEDTAVYYCVRHGNFGNSYVSWFAYWGQ GTLVTVSSGGGGSGGGGSGGGGSGGGGSQA VVTQEPSLTVSPGGTVTLTCRSSTGAVTTSNYA NWVQQKPGQAPRGLIGGTNKRAPWTPARFSG SLLGDKAALTLSGAQPEDEAEYFCALWYSNLW VFGGGTKLTVLGGGGS | 1011 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYSSYPYTF GQGTKLEIKRTVAAPSVFIFPPSDEQLKSGTASV VCLLNNFYPREAKVQWKVDNALQSGNSQESVT EQDSKDSTYSLSSTLTLSKADYEKHKVYACEVT HQGLSSPVTKSFNRGEC | 1012 |
| | | Second Half Antibody (Fc sequence not shown) | SQQIYGVVYGNVTFHVPSNVPLKEVLWKKQKD KVAELENSEFRAFSSFKNRVYLDTVSGSLTIYNL TSSDEDEYEMESPNITDTMKFFLYVLESGGGGS | 1008 |

TABLE 20-A-continued

Amino acid sequences

| Simplified Construct Name | Original Construct Name | Chain Description | Amino Acid Sequence | SEQ ID NO: |
|---|---|---|---|---|
| CD3hi TSP1L | CD19_NEG258_CD3_16 nM-lysozyme Trispecific | First Half Antibody Heavy Chain (Fc sequence not shown) | QVQLVQSGAEVKKPGASVKVSCKASGYTFTTY WIQWVRQAPGQRLEWMGAVYPGDADTRYTQK FQGRVTLTADRSASTAYMELSSLRSEDTAVYYC GRDAGLEYYALDYWGQGTLVTVSSASTKGPSV FPLAPSSKSTSGGTAALGCLVKDYFPEPVTVSW NSGALTSGVHTFPAVLQSSGLYSLSSVVTVPSS SLGTQTYICNVNHKPSNTKVDKRVEPKSCGGG GSGGGGSEVQLVESGGGLVQPGGSLKLSCAA SGFTFNTYAMNWVRQASGKGLEWVGRIRSKY NNYATYYADSVKDRFTISRDDSKSTLYLQMNSL KTEDTAVYYCVRHGNFGNSYVSWFAYWGQGT LVTVSSGGGGSGGGGSGGGGSGGGGSQAVV TQEPSLTVSPGGTVTLTCRSSTGAVTTSNYAN WVQQKPGQAPRGLIGGTNKRAPWTPARFSGS LLGDKAALTLSGAQPEDEAEYFCALWYSNLWV FGGGTKLTVLGGGGS | 1006 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYANFPLYT FGQGTKLEIKRTVAAPSVFIFPPSDEQLKSGTAS VVCLLNNFYPREAKVQWKVDNALQSGNSQESV TEQDSKDSTYSLSSTLTLSKADYEKHKVYACEV THQGLSSPVTKSFNRGEC | 1007 |
| | | Second Half Antibody (Fc sequence not shown) | DVQLQASGGGSVQAGGSLRLSCAASGYTIGPY CMGWFRQAPGKEREGVAAINMGGGITYYADSV KGRFTISQDNAKNTVYLLMNSLEPEDTAIYYCAA DSTIYASYYECGHGLSTGGYGYDSWGQGTQVT VSSGGGGS | 1013 |
| CD3hi TSP2L | CD19_NEG218_CD3_16 nM-lysozyme Trispecific | First Half Antibody Heavy Chain (Fc sequence not shown) | EVQLVQSGAEVKKPGESLKISCKASGYSFTNY WMNWVRQMPGKGLEWMGMIHPSDSEIRLNQK FQGQVTLSVDKSIGTAYMQWSSLKASDTAMYY CSRWYYLSSPMDYWGQGTTVTVSSASTKGPS VFPLAPSSKSTSGGTAALGCLVKDYFPEPVTVS WNSGALTSGVHTFPAVLQSSGLYSLSSVVTVP SSSLGTQTYICNVNHKPSNTKVDKRVEPKSCG GGSGGGGSEVQLVESGGGLVQPGGSLKLSC AASGFTFNIYAMNWVRQASGKGLEWVGRIRS KYNNYATYYADSVKDRFTISRDDSKSTLYLQMN SLKTEDTAVYYCVRHGNFGNSYVSWFAYWGQ GTLVTVSSGGGGSGGGGSGGGGSGGGGSQA VVTQEPSLTVSPGGTVTLTCRSSTGAVTTSNYA NWVQQKPGQAPRGLIGGTNKRAPWTPARFSG SLLGDKAALTLSGAQPEDEAEYFCALWYSNLW VFGGGTKLTVLGGGGS | 1011 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYSSYPYTF GQGTKLEIKRTVAAPSVFIFPPSDEQLKSGTASV VCLLNNFYPREAKVQWKVDNALQSGNSQESVT EQDSKDSTYSLSSTLTLSKADYEKHKVYACEVT HQGLSSPVTKSFNRGEC | 1012 |
| | | Second Half Antibody (Fc sequence not shown) | DVQLQASGGGSVQAGGSLRLSCAASGYTIGPY CMGWFRQAPGKEREGVAAINMGGGITYYADSV KGRFTISQDNAKNTVYLLMNSLEPEDTAIYYCAA DSTIYASYYECGHGLSTGGYGYDSWGQGTQVT VSSGGGGS | 1013 |
| CD3N BSP1 - 2 arm | CD19_NEG258_CD3_16 nM Bispecific | First Half Antibody Heavy Chain (Fc sequence not shown) | QVQLVQSGAEVKKPGASVKVSCKASGYTFTTY WIQWVRQAPGQRLEWMGAVYPGDADTRYTQK FQGRVTLTADRSASTAYMELSSLRSEDTAVYYC GRDAGLEYYALDYWGQGTLVTVSSASTKGPSV FPLAPSSKSTSGGTAALGCLVKDYFPEPVTVSW NSGALTSGVHTFPAVLQSSGLYSLSSVVTVPSS SLGTQTYICNVNHKPSNTKVDKRVEPKSC | 1014 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYANFPLYT | 1007 |

TABLE 20-A-continued

Amino acid sequences

| Simplified Construct Name | Original Construct Name | Chain Description | Amino Acid Sequence | SEQ ID NO: |
|---|---|---|---|---|
| | | | FGQGTKLEIKRTVAAPSVFIFPPSDEQLKSGTAS VVCLLNNFYPREAKVQWKVDNALQSGNSQESV TEQDSKDSTYSLSSTLTLSKADYEKHKVYACEV THQGLSSPVTKSFNRGEC | |
| | | Second Half Antibody (Fc sequence not shown) | EVQLVESGGGLVQPGGSLKLSCAASGFTFNTY AMNWVRQASGKGLEWVGRIRSKYNNYATYYA DSVKDRFTISRDDSKSTLYLQMNSLKTEDTAVY YCVRHGNFGNSYVSWFAYWGQGTLVTVSSGG GGSGGGGSGGGGSGGGGSQAVVTQEPSLTV SPGGTVTLTCRSSTGAVTTSNYANWVQQKPG QAPRGLIGGTNKRAPWTPARFSGSLLGDKAAL TLSGAQPEDEAEYFCALWYSNLWVFGGGTKLT VLGGGGS | 1015 |
| CD3hi BSP2 - 2 arm | CD19_ NEG218_CD3_ 16 nM Bispecific | First Half Antibody Heavy Chain (Fc sequence not shown) | EVQLVQSGAEVKKPGESLKISCKASGYSFTNY WMNWVRQMPGKGLEWMGMIHPSDSEIRLNQK FQGQVTLSVDKSIGTAYMQWSSLKASDTAMYY CSRWYYLSSPMDYWGQGTTVTVSSASTKGPS VFPLAPSSKSTSGGTAALGCLVKDYFPEPVTVS WNSGALTSGVHTFPAVLQSSGLYSLSSVVTVP SSSLGTQTYICNVNHKPSNTKVDKRVEPKSC | 1016 |
| | | First Half Antibody Light Chain | EIVMTQSPATLSVSPGERATLSCRASQDVGTAV AWYQQKPGQAPRLLIYWASTRHTGIPARFSGS GSGTEFTLTISSLQSEDFAVYFCQQYSSYPYTF GQGTKLEIKRTVAAPSVFIFPPSDEQLKSGTASV VCLLNNFYPREAKVQWKVDNALQSGNSQESVT EQDSKDSTYSLSSTLTLSKADYEKHKVYACEVT HQGLSSPVTKSFNRGEC | 1012 |
| | | Second Half Antibody (Fc sequence not shown) | EVQLVESGGGLVQPGGSLKLSCAASGFTFNTY AMNWVRQASGKGLEWVGRIRSKYNNYATYYA DSVKDRFTISRDDSKSTLYLQMNSLKTEDTAVY YCVRHGNFGNSYVSWFAYWGQGTLVTVSSGG GGSGGGGSGGGGSGGGGSQAVVTQEPSLTV SPGGTVTLTCRSSTGAVTTSNYANWVQQKPG QAPRGLIGGTNKRAPWTPARFSGSLLGDKAAL TLSGAQPEDEAEYFCALWYSNLWVFGGGTKLT VLGGGGS | 1015 |

Table 20-B below shows the full length amino acid sequences of the constructs shown in Table 20-A (using the simplified construct names), including Fc sequences.

TABLE 20-B

Amino acid sequences

| Construct Name | Chain Description | Amino Acid Sequence | SEQ ID NO: |
|---|---|---|---|
| CD3hi TSP1 | First Half Antibody Heavy Chain (includes Fc sequence) | QVQLVQSGAEVKKPGASVKVSCKASGYTFTTYWIQWV RQAPGQRLEWMGAVYPGDADTRYTQKFQGRVTLTAD RSASTAYMELSSLRSEDTAVYYCGRDAGLEYYALDYW GQGTLVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKSTLYLQMNSLKTEDTAVYYCVR HGNFGNSYVSWFAYWGQGTLVTVSSGGGGSGGGGS GGGGSGGGGSQAVVTQEPSLTVSPGGTVTLTCRSST GAVTTSNYANWVQQKPGQAPRGLIGGTNKRAPWTPA RFSGSLLGDKAALTLSGAQPEDEAEYFCALWYSNLWV FGGGTKLTVLGGGGSDKTHTCPPCPAPELLGGPSVFL FPPKPKDTLMISRTPEVTCVVVAVSHEDPEVKFNWYVD GVEVHNAKTKPREEQYASTYRVVSVLTVLHQDWLNGK EYKCKVSNKALAAPIEKTISKAKGQPREPQVCTLPPSR EEMTKNQVSLSCAVKGFYPSDIAVEWESNGQPENNYK | 1321 |

TABLE 20-B-continued

Amino acid sequences

| Construct Name | Chain Description | Amino Acid Sequence | SEQ ID NO: |
|---|---|---|---|
| | | TTPPVLDSDGSFFLVSKLTVDKSRWQQGNVFSCSVMH EALHNHYTQKSLSLSPGK | |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYANFPLYTFGQGTKLEIKRTVAAP SVFIFPPSDEQLKSGTASVVCLLNNFYPREAKVQWKVD NALQSGNSQESVTEQDSKDSTYSLSSTLTLSKADYEK HKVYACEVTHQGLSSPVTKSFNRGEC | 1007 |
| | Second Half Antibody (includes Fc sequence) | SQQIYGVVYGNVTFHVPSNVPLKEVLWKKQKDKVAEL ENSEFRAFSSFKNRVYLDTVSGSLTIYNLTSSDEDEYE MESPNITDTMKFFLYVLESGGGGSDKTHTCPPCPAPEL LGGPSVFLFPPKPKDTLMISRTPEVTCVVVAVSHEDPE VKFNWYVDGVEVHNAKTKPREEQYASTYRVVSVLTVL HQDWLNGKEYKCKVSNKALAAPIEKTISKAKGQPREP QVYTLPPCREEMTKNQVSLWCLVKGFYPSDIAVEWES NGQPENNYKTTPPVLDSDGSFFLYSKLTVDKSRWQQG NVFSCSVMHEALHNRYTQKSLSLSPGK | 1322 |
| CD3med TSP1 | First Half Antibody Heavy Chain (includes Fc sequence) | QVQLVQSGAEVKKPGASVKVSCKASGYTFTTYWIQWV RQAPGQRLEWMGAVYPGDADTRYTQKFQGRVTLTAD RSASTAYMELSSLRSEDTAVYYCGRDAGLEYYALDYW GQGTLVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKNTAYLQMNSLKTEDTAVYYCVR HGNFGNSYVSWFAHWGQGTLVTVSSGGGGSGGGGS GGGGSGGGGSQAVVTQEPSLTVSPGGTVTLTCGSST GAVTSSNYANWVQQKPGQAPRGLIGGTNKRAPWTPA RFSGSLLGGKAALTLSGAQPEDEAEYYCALWYSNLWV FGGGTKLTVLGGGGSDKTHTCPPCPAPELLGGPSVFL FPPKPKDTLM1SRTPEVTCVVVAVSHEDPEVKFNWYVD GVEVHNAKTKPREEQYASTYRVVSVLTVLHQDWLNGK EYKCKVSNKALAAPIEKTISKAKGQPREPQVCTLPPSR EEMTKNQVSLSCAVKGFYPSDIAVEWESNGQPENNYK TTPPVLDSDGSFFLVSKLTVDKSRWQQGNVFSCSVMH EALHNHYTQKSLSLSPGK | 1323 |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYANFPLYTFGQGTKLEIKRTVAAP SVFIFPPSDEQLKSGTASVVCLLNNFYPREAKVQWKVD NALQSGNSQESVTEQDSKDSTYSLSSTLTLSKADYEK HKVYACEVTHQGLSSPVTKSFNRGEC | 1007 |
| | Second Half Antibody (includes Fc sequence) | SQQIYGVVYGNVTFHVPSNVPLKEVLWKKQKDKVAEL ENSEFRAFSSFKNRVYLDTVSGSLTIYNLTSSDEDEYE MESPNITDTMKFFLYVLESGGGGSDKTHTCPPCPAPEL LGGPSVFLFPPKPKDTLMISRTPEVTCVVVAVSHEDPE VKFNWYVDGVEVHNAKTKPREEQYASTYRVVSVLTVL HQDWLNGKEYKCKVSNKALAAPIEKTISKAKGQPREP QVYTLPPCREEMTKNQVSLWCLVKGFYPSDIAVEWES NGQPENNYKTTPPVLDSDGSFFLYSKLTVDKSRWQQG NVFSCSVMHEALHNRYTQKSLSLSPGK | 1322 |
| CD3lo TSP1 | First Half Antibody Heavy Chain (includes Fc sequence) | QVQLVQSGAEVKKPGASVKVSCKASGYTFTTYWIQWV RQAPGQRLEWMGAVYPGDADTRYTQKFQGRVTLTAD RSASTAYMELSSLRSEDTAVYYCGRDAGLEYYALDYW GQGTLVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKSTAYLQMNSLKTEDTAVYYCVR HGNFGNSYVSWFAYWGQGTLVTVSSGGGGSGGGGS GGGGSGGGGSQAVVTQEPSLTVSPGGTVTLTCRSST GAVTTSNYANWVQQKPGQAPRGLIGGTNKRAPWTPA RFSGSLLGDKAALTLSGAQPEDEAEYFCALWYSNLWV FGGGTKLTVLGGGGSDKTHTCPPCPAPELLGGPSVFL FPPKPKDTLMISRTPEVTCVVVAVSHEDPEVKFNWYVD GVEVHNAKTKPREEQYASTYRVVSVLTVLHQDWLNGK | 1324 |

TABLE 20-B-continued

Amino acid sequences

| Construct Name | Chain Description | Amino Acid Sequence | SEQ ID NO: |
|---|---|---|---|
| | | EYKCKVSNKALAAPIEKTISKAKGQPREPQVCTLPPSR EEMTKNQVSLSCAVKGFYPSDIAVEWESNGQPENNYK TTPPVLDSDGSFFLVSKLTVDKSRWQQGNVFSCSVMH EALHNHYTQKSLSLSPGK | |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYANFPLYTFGQGTKLEIKRTVAAP SVFIFPPSDEQLKSGTASVVCLLNNFYPREAKVQWKVD NALQSGNSQESVTEQDSKDSTYSLSSTLTLSKADYEK HKVYACEVTHQGLSSPVTKSFNRGEC | 1007 |
| | Second Half Antibody (includes Fc sequence) | SQQIYGVVYGNVTFHVPSNVPLKEVLWKKQKDKVAEL ENSEFRAFSSFKNRVYLDTVSGSLTIYNLTSSDEDEYE MESPNITDTMKFFLYVLESGGGGSDKTHTCPPCPAPEL LGGPSVFLFPPKPKDTLMISRTPEVTCVVVAVSHEDPE VKFNWYVDGVEVHNAKTKPREEQYASTYRVVSVLTVL HQDWLNGKEYKCKVSNKALAAPIEKTISKAKGQPREP QVYTLPPCREEMTKNQVSLWCLVKGFYPSDIAVEWES NGQPENNYKTTPPVLDSDGSFFLYSKLTVDKSRWQQG NVFSCSVMHEALHNRYTQKSLSLSPGK | 1322 |
| CD3hi TSP2 | First Half Antibody Heavy Chain (includes Fc sequence) | EVQLVQSGAEVKKPGESLKISCKASGYSFTNYWMNWV RQMPGKGLEWMGMIHPSDSEIRLNQKFQGQVTLSVD KSIGTAYMQWSSLKASDTAMYYCSRWYYLSSPMDYW GQGTTVTVSSASTKGPSVEPLAPSSKSTSGGTAALGC LVKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKSTLYLQMNSLKTEDTAVYYCVR HGNFGNSYVSWFAYWGQGTLVTVSSGGGGSGGGGS GGGGSGGGGSQAVVTQEPSLTVSPGGTVTLTCRSST GAVTTSNYANWVQQKPGQAPRGLIGGTNKRAPWTPA RFSGSLLGDKAALTLSGAQPEDEAEYFCALWYSNLWV FGGGTKLTVLGGGGSDKTHTCPPCPAPELLGGPSVFL FPPKPKDTLMISRTPEVTCVVVAVSHEDPEVKFNWYVD GVEVHNAKTKPREEQYASTYRVVSVLTVLHQDWLNGK EYKCKVSNKALAAPIEKTISKAKGQPREPQVCTLPPSR EEMTKNQVSLSCAVKGFYPSDIAVEWESNGGPENNYK TTPPVLDSDGSFFLVSKLTVDKSRWQQGNVFSCSVMH EALHNHYTQKSLSLSPGK | 1325 |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYSSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHGGLSSPVTKSFNRGEC | 1012 |
| | Second Half Antibody (includes Fc sequence) | SGQIYGVVYGNVTFHVPSNVPLKEVLWKKQKDKVAEL ENSEFRAFSSFKNRVYLDTVSGSLTIYNLTSSDEDEYE MESPNITDTMKFFLYVLESGGGGSDKTHTCPPCPAPEL LGGPSVFLFPPKPKDTLMISRTPEVTCVVVAVSHEDPE VKFNWYVDGVEVHNAKTKPREEQYASTYRVVSVLTVL HQDWLNGKEYKCKVSNKALAAPIEKTISKAKGQPREP QVYTLPPCREEMTKNQVSLWCLVKGRYPSDIAVEWES NGQPENNYKTTPPVLDSDGSFFLYSKLTVDKSRWQQG NVFSCSVMHEALHNRYTQKSLSLSPGK | 1322 |
| CD3hi TSP1L | First Half Antibody Heavy Chain (includes Fc sequence) | QVQLVQSGAEVKKPGASVKVSCKASGYTFTTYWIQWV RQAPGQRLEWMGAVYPGDADTRYTQKFQGRVTLTAD RSASTAYMELSSLRSEDTAVYYCGRDAGLEYYALDYW GQGTLVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKSTLYLQMNSLKTEDTAVYYCVR HGNFGNSYVSWFAYWGQGTLVTVSSGGGGSGGGGS GGGGSGGGGSQAVVTQEPSLTVSPGGTVTLTCRSST GAVTTSNYANWVQQKPGQAPRGLIGGTNKRAPWTPA RFSGSLLGDKAALTLSGAQPEDEAEYFCALWYSNLWV FGGGTKLTVLGGGSDKTHTCPPCPAPELLGGPSVFL | 1321 |

TABLE 20-B-continued

Amino acid sequences

| Construct Name | Chain Description | Amino Acid Sequence | SEQ ID NO: |
|---|---|---|---|
| | | FPPKPKDTLMISRTPEVTCVVVAVSHEDPEVKFNWYVD GVEVHNAKTKPREEQYASTYRVVSVLTVLHQDWLNGK EYKCKVSNKALAAPIEKTISKAKGQPREPQVCTLPPSR EEMTKNQVSLSCAVKGFYPSDIAVEWESNGQPENNYK TTPPVLDSDGSFFLVSKLTVDKSRWQQGNVFSCSVMH EALHNHYTQKSLSLSPGK | |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYANFPLYTFGQGTKLEIKRTVAAP SVFIFPPSDEQLKSGTASVVCLLNNFYPREAKVQWKVD NALQSGNSQESVTEQDSKDSTYSLSSTLTLSKADYEK HKVYACEVTHQGLSSPVTKSFNRGEC | 1007 |
| | Second Half Antibody (includes Fc sequence) | DVQLQASGGGSVQAGGSLRLSCAASGYTIGPYCMGW FRQAPGKEREGVAAINMGGGITYYADSVKGRFTISQDN AKNTVYLLMNSLEPEDTAIYYCAADSTIYASYYECGHGL STGGYGYDSWGQGTQVTVSSGGGGSDKTHTCPPCP APELLGGPSVFLFPPKPKDTLMISRTPEVTCVVVAVSH EDPEVKFNWYVDGVEVHNAKTKPREEQYASTYRVVSV LTVLHQDWLNGKEYKCKVSNKALAAPIEKTISKAKGQP REPQVYTLPPCREEMTKNQVSLWCLVKGFYPSDIAVE WESNGQPENNYKTTPPVLDSDGSFFLYSKLTVDKSRW QQGNVFSCSVNHEALHNRYTQKSLSLSPGK | 1326 |
| CD3hi TSP2L | First Half Antibody Heavy Chain (includes Fc sequence) | EVQLVQSGAEVKKPGESLKISCKASGYSFTNYWMNWV RQMPGKGLEWMGMIHPSDSEIRLNQKFQGQVTLSVD KSIGTAYMQWSSLKASDTAMYYCSRWYYLSSPMDYW GQGTTVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKRVEPKSC GGGGSGGGGSEVQLVESGGGLVQPGGSLKLSCAASG FTFNTYAMNWVRQASGKGLEWVGRIRSKYNNYATYY ADSVKDRFTISRDDSKSTLYLQMNSLKTEDTAVYYCVR HGNFGNSYVSWFAYWGQGTLVTVSSGGGGSGGGGS GGGGSGGGGSQAVVTQEPSLTVSPGGTVTLTCRSST GAVTTSNYANWVQQKPGQAPRGLIGGTNKRAPWTPA RFSGSLLGDKAALTLSGAQPEDEAEYFCALWYSNLWV FGGGTKLTVLGGGGSDKTHTCPPCPAPELLGGPSVFL FPPKPKDTLMISRTPEVTCVVVAVSHEDPEVKFNWYVD GVEVHNAKTKPREEQYASTYRVVSVLTVLHQDWLNGK EYKCKVSNKALAAPIEKTISKAKGQPREPQVCTLPPSR EEMTKNGVSLSCAVKGFYPSDIAVEWESNGQPENNYK TTPPVLDSDGSFFLVSKLTVDKSRWQQGNVFSCSVMH EALHNHYTQKSLSLSPGK | 1325 |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYSSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHGGLSSPVTKSFNRGEC | 1013 |
| | Second Half Antibody (includes Fc sequence) | DVQLQASGGGSVQAGGSLRLSCAASGYTIGPYCMGW FRQAPGKEREGVAAINMGGGITYYADSVKGRFTISQDN AKNTVYLLMNSLEPEDTAIYYCAADSTIYASYYECGHGL STGGYGYDSWGQGTQVTVSSGGGGSDKTHTCPPCP APELLGGPSVFLFPPKPKDTLMISRTPEVTCVVVAVSH EDPEVKFNWYVDGVEVHNAKTKPREEQYASTYRVVSV LTVLHQDWLNGKEYKCKVSNKALAAPIEKTISKAKGQP REPQVYTLPPCREEMTKNQVSLWCLVKGFYPSDIAVE WESNGQPENNYKTTPPVLDSDGSFFLYSKLTVDKSRW QQGNVFSCSVNHEALHNRYTQKSLSLSPGK | 1326 |
| CD3hi BSP1-2 arm | First Half Antibody Heavy Chain (includes Fc sequence) | QVQLVQSGAEVKKPGASVKVSCKASGYTFTTYWIQWV RQAPGQRLEWMGAVYPGDADTRYTQKFQGRVTLTAD RSASTAYMELSSLRSEDTAVYYCGRDAGLEYYALDYW GQGTLVTVSSASTKGPSVFPLAPSSKSTSGGTAALGCL VKDYFPEPVTVSWNSGALTSGVHTFPAVLQSSGLYSL SSVVTVPSSSLGTQTYICNVNHKPSNTKVDKRVEPKSC DKTHTCPPCPAPELLGGPSVFLFPPKPKDTLMISRTPE VTCVVVAVSHEDPEVKFNWYVDGVEVHNAKTKPREE QYASTYRVVSVLTVLHQDWLNGKEYKCKVSNKALAAPI EKTISKAKGQPREPQVCTLPPSREEMTKNQVSLSCAV | 1327 |

TABLE 20-B-continued

Amino acid sequences

| Construct Name | Chain Description | Amino Acid Sequence | SEQ ID NO: |
|---|---|---|---|
| | | KGFYPSDAVEWESNGQPENNYKTTPPVLDSDGSFFL VSKLTVDKSRWQQGNVFSCSVMHEALHNHYTQKSLSL SPGK | |
| | First Half Antibody Light Chain | EIVMTQSPATLSVSPGERATLSCRASQDVGTAVAWYQ QKPGQAPRLLIYWASTRHTGIPARFSGSGSGTEFTLTIS SLQSEDFAVYFCQQYANFPLYTFGQGTKLEIKRTVAAP SVFIFPPSDEQLKSGTASVVCLLNNFYPREAKVQWKVD NALQSGNSQESVTEQDSKDSTYSLSSTLTLSKADYEK HKVYACEVTHQGLSSPVTKSFNRGEC | 1007 |
| | Second Half Antibody (includes Fc sequence) | EVQLVESGGGLVQPGGSLKLSCAASGFTFNTYAMNW VRQASGKGLEWVGRIRSKYNNYATYYADSVKDRFTIS RDDSKSTLYLQMNSLKTEDTAVYYCVRHGNFGNSYVS WFAYWGQGTLVTVSSGGGGSGGGGSGGGGSGGGG SGAVVTQEPSLTVSPGGTVTLTCRSSTGAVTTSNYAN WVQQKPGQAPRGLIGGTNKRAPWTPARFSGSLLGDK AALTLSGAQPEDEAEYFCALWYSNLWVFGGGTKLTVL GGGGSDKTHTCPPCPAPELLGGPSVFLFPPKPKDTLMI SRTPEVTCVVVAVSHEDPEVKFNWYVDGVEVHNAKTK PREEQYASTYRVVSVLTVLHQDWLNGKEYKCKVSNKA LAAPIEKTISKAKGQPREPQVYTLPPCREEMTKNQVSL WCLVKGFYPSDIAVEWESNGQPENNYKTTPPVLDSDG SFFLYSKLTVDKSRWQQGNVFSCSVMHEALHNRYTQK SLSLSPGK | 1328 |
| CD3hi BSP2 - 2 arm | First Half Antibody Heavy Chain (includes Fc sequence) | EVQLVQSGAEVKKPGESLKISCKASGYSFTNYWMNVW RQMPGKGLEWMGMIHPSDSEIRLNQKFQGQVTLSVD KSIGTAYMQWSSLKASDTAMYYCSRWYYLSSPMDYW GQGTTVTVSSASTKGPSVFPLAPSSKSTSGGTAALGC LVKDYFPEPVTVSWNSGALTSGVHTFPAVLQSSGLYSL SSVVTVPSSSLGTQTYICNVNHKPSNTKVDKRVEPKSC DKTHTCPPCPAPELLGGPSVFLFPPKPKDTLMISRTPE VTCVVVAVSHEDPEVKFNWYVDGVEVHNAKTKPREE QYASTYRVVSVLTVLHQDWLNGKEYKCKVSNKALAAPI EKTISKAKGQPREPQVCTLPPSREEMTKNQVSLSCAV KGFYPSDIAVEWESNGQPENNYKTTPPVLDSDGSFFL VSKLTVDKSRWQQGNVFSCSVMHEALHNHYTQKSLSL SPGK | 1329 |
| | First Half Antibody Light Chain | EIVMTQSPATLSVSPGERATLSCRASQDVGTAVAWYQ QKPGQAPRLLIYWASTRHTGPARFSGSGSGTEFTLTIS SLQSEDFAVYFCQQYSSYPYTFGQGTKLEIKRTVAAPS VFIFPPSDEQLKSGTASVVCLLNNFYPREAKVQWKVDN ALQSGNSQESVTEQDSKDSTYSLSSTLTLSKADYEKHK VYACEVTHQGLSSPVTKSFNRGEC | 1012 |
| | Second Half Antibody (includes Fc sequence) | EVQLVESGGGLVQPGGSLKLSCAASGFTFNTYAMNW VRQASGKGLEWVGRIRSKYNNYATYYADSVKDRFTIS RDDSKSTLYLQMNSLKTEDTAVYYCVRHGNFGNSYVS WFAYWGQGTLVTVSSGGGGSGGGGSGGGGSGGGG SQAVVTQEPSLTVSPGGTVTLTCRSSTGAVTTSNYAN WVQQKPGQAPRGLIGGTNKRAPWTPARFSGSLLGDK AALTLSGAQPEDEAEYFCALWYSNLWVFGGGTKLTVL GGGGSDKTHTCPPCPAPELLGGPSVFLFPPKPKDTLMI SRTPEVTCVVVAVSHEDPEVKFNWYVDGVEVHNAKTK PREEQYASTYRVVSVLTVLHQWLNGKEYKCKVSNKA LAAPIEKTISKAKGQPREPQVYTLPPCREEMTKNQVSL WCLVKGEYPSDIAVEWESNGQPENNYKTTPPVLDSDG SFFLYSKLTVDKSRWQQGNVFSCSVMHEALHNRYTQK SLSLSPGK | 1328 |

8.1.1.2. Expression and Purification

BBMs and TBMs were expressed transiently by co-transfection of the respective chains in HEK293 cells. Briefly, transfection of the cells with the heavy and light chain plasmids was performed using PEI as transfection reagent with a final DNA:PEI ratio of 1:3. 1 mg of plasmid per liter of culture was used for transfection of cultures having 2.0 million cells/mL of serum media. After 5 days of expression, BBMs and TBMs were harvested by clarification of the media via centrifugation and filtration. Purification was performed via anti-CH1 affinity batch binding (CaptureSelect IgG-CH1 Affinity Matrix, Thermo-Fisher Scientific, Waltham, MA, USA) or Protein A (rProteinA Sepharose, Fast flow, GE Healthcare, Uppsala, Sweden) batch binding using 1 ml resin/100 mL supernatant. The protein was allowed to bind for a minimum of 2 hours with gentle mixing, and the supernatant loaded onto a gravity filtration column. The resin was washed with 20-50 CV of PBS. BBMs and TBMs were eluted with 20 CV of 50 mM citrate, 90 mM NaCl pH 3.2. 50 mM sucrose. The eluted BBM and TBM fractions were adjusted to pH 5.5 with 1 M sodium citrate 50 mM sucrose. Preparative size exclusion chromatography was performed using Hi Load 16/60 Superdex 200 grade column (GE Healthcare Life Sciences, Uppsala, Sweden) as a final polishing step when aggregates were present. To confirm that the identity of the proteins of the BBMs and TBMs expressed matched the predicted masses for the primary amino acid sequences, proteins were analyzed by high-performance liquid chromatography coupled to mass spectrometry.

8.1.1.3. CD3 Affinity Measurements

The affinity of the CD3hi, CD3med, and CD3lo mAbs to CD3 were determined at 25° C. using a Biacore T200 system. Briefly, anti-hFc IgG1 was immobilized on a CM5 chip. After capturing CD3-Fc (1 µg/ml in HBS-EP+ buffer, flow rate of 50 µl/min, with a 30 second injection time) kinetic data was acquired by subsequent injections of 1:2 dilution series of the different antibodies in HBS-EP+ buffer.

Data were evaluated using the Biacore T200 evaluation software version 1.0. The raw data were double referenced, i.e. the response of the measuring flow cell was corrected for the response of the reference flow cell, and in a second step the response of a blank injection was subtracted. Finally, the sensorgrams were fitted by applying 1:1 binding model to calculate kinetic rate constants and dissociation equilibrium constants. $R_{max}$ was set at local. Data were processed individually for each run.

8.2. Example 2: Ability of BBMs to Elicit Redirected T-Cell Cytotoxic Activity (RTCC) Against CD19+ Target Cells 8.2.1. Materials and Methods A RTCC assay with the BBMs of Example 1 was performed to measure the ability of the BBMs to elicit RTCC against CD19+ Nalm6-luc and Karpas422-luc cells. Nalm-6 is a human B cell precursor leukemia cell line and Karpas422 is a human B-cell non-hodgkin lymphoma cell line. Briefly, Nalm6 and Karpas422 cells engineered to express the firefly luciferase reporter gene were cultured in RPM11640 culture media with 10% fetal bovine serum (FBS). 10,000 target cells with serial diluted BBMs or gH isotype antibody control (agH-CD3hi) were seeded on 384-well flat-bottom microtiter plate. Primary human T cells were isolated from cryopreserved peripheral blood mononuclear cells (PBMCs) and expanded using anti-CD3 and anti-CD28 dynabeads (Thermo fisher, catalog #11131D) and subsequently cryopreserved. Expanded T cells were thawed and aliquoted to the plate to achieve an effector cell (i.e., T cell) to target cell (i.e., cancer cell) ratio (E:T ratio) of 3:1. Plates were incubated in a 37° C. incubator with 5% CO2 overnight. Following the co-incubation, Bright Glo (Promega, catalog #E2620) was added to all wells and the luminescence signal was subsequently measured on an Envision (Perkin Elmer). Target cells with Bright Glo served as maximal signal. The percent RTCC of target cells was calculated using the following formula: [100−(sample/maximal signal)*100%].

8.2.2. Results

Results are shown in FIGS. 4A-4B. BBMs based on both NEG258 and NEG218 mediated RTCC activity against Nalm6-luc and Karpas422-luc cells whereas gH isotype antibody (control) was not active, as expected.

8.3. Example 3: Ability of BBMs to Elicit T-Cell Proliferation 8.3.1. Materials and Methods The BBMs described in Example 1, containing the variable regions of NEG258 and NEG218, were evaluated for their ability to induce T cell proliferation upon co-culture with CD19 expressing target cells. Briefly, Karpas422 and Nalm-6 target cells stably expressing firefly luciferase were irradiated on the day of the assay and plated at a density of 60,000 cells per well in a Costar 96 well plate (Corning, Cat #3904) in T Cell Media (TCM) [RPMI-1640 (ThermoFisher Scientific, Cat #11875-085), 10% FBS (Seradigm, Cat #1500-500), 1% L-Glutamine (Thermo Fisher Scientific, Cat #25830-081), 1% Non Essential Amino Acids (Thermo Fisher Scientific, Cat #11140-050), 1% Pen/Strep (Thermo Fisher Scientific, Cat #15070063), 1% HEPES (Thermo Fisher Scientific, Cat #15630080), Sodium Pyruvate (Thermo Fisher Scientific, Cat #11360-070), 0.1% Beta-mercaptoethanol (Thermo Fisher Scientific, Cat #21985-023)]. Peripheral blood mononuclear cells (PBMCs) previously isolated from Leukopak donors (Hemacare) and cryopreserved were thawed and Pan T cells were isolated by negative selection using the Pan T cell Isolation Kit, human [Miltenyi Biotec, Cat #130-096-535] following the manufacturer's protocol. Isolated T cells were labelled with 5 µM Cell Trace Violet (CTV) (Thermo Fisher Scientific, Cat #C34557) following the manufacturer's protocol and 60,000 CTV labeled T cells were co-cultured with 60,000 target cells to achieve an E:T ratio of 1:1. A dilution series of the NEG258- and NEG218-based BBMs and control binding molecules (agH-CD3hi) ranging from 16 µM-10,000 µM was added to cells and the plates were incubated in a 5% CO2, 37° C. incubator for 96 hrs. After incubation, the cells were harvested, treated with Human TruStain FcX (Fc Block) [Biolegend, Cat #422302] following manufacturer instructions and then stained with Fixable Viability Dye eFlour 780 (ThermoFisher Scientific, Cat #65-0865-14) by incubation at 4 C for 30 mins. The cells were then washed twice using FACS Buffer and stained with PerCP-Cy5.5 conjugated anti-human CD3 mAb (Biolegend, Cat #317336) by incubation at 4° C. for 30 mins. The samples were then run on BD LSR Fortessa and analyzed using FlowJo to determine % proliferated CD3+ T cells based on CD3 staining and dilution of Cell Trace Violet dye.

8.3.2. Results

Both NEG258- and NEG218-based BBMs induced proliferation of T cells upon co-culture with two different CD19 expressing target cell lines (FIGS. 5A-5B). The T cell proliferation effect was dose-dependent, and the NEG258-based BBM showed more potent activity than the NEG218-based BBM. The control antibody did not induce any T cell proliferation indicating that CD19 target-specific engagement was required for the proliferation of T cells.

8.4. Example 4: Ability of TBMs to Elicit CD2 Dependent T Cell Activation 8.4.1. Materials & Methods A Jurkat cell line (JNL, an immortalized human T-cell line) that stably expresses a luciferase reporter gene driven by the NFAT promoter was used to measure T cell activation. The level of CD2 expression in JNL cells was confirmed by flow cytometry (FIG. 6A). In order to generate CD2 knockout (KO) cells by CRISPR (Clustered Regularly Interspaced Short Palindromic Repeats), JNL cells were electroporated with a CD2 Cas9 ribonucleoprotein complex. CD2⁻ cells were subsequently sorted to enrich for a uniform CD2⁻ population (FIG. 6B). A JNL reporter assay with CD2+ and CD2⁻ JNL cells was then performed to measure bispecfic or trispecific construct-dependent T cell activation. In brief, 10,000 Nalm6 or Karpas422 cells with serial diluted BBMs or TBMs were seeded on 384-well flat-bottom microtiter plate. JNL cells were then added to the plate to achieve effector to target ratio of 3:1. Plates were incubated at a 37° C. incubator with 5% $CO_2$ for overnight. Following the co-incubation, Bright Glo (Promega, catalog #E2620) was added to all wells and the luminescence signal was subsequently measured on an Envision (Perkin Elmer).

8.4.2. Results

Both BBMs and TBMs induced dose-dependent increase in luminescence when incubated with CD2 WT JNL cells, and the response level was higher with TBMs (FIGS. 6C-6F). When CD2-KO JNL cells were used as effector, decreased T cell activation was observed with TBMs as compared to corresponding BBMs, suggesting that the advantage of TBMs is dependent on CD2 expression on the T cells.

8.5. Example 5: Binding of NEG258- and NEG218-Based TBMs to Cyno B Cells

8.5.1. Materials and Methods

Cynomolgus (cyno) PBMCs (iQ Biosciences #IQB-MnPB102) were depleted of CD3+ cells using MACS positive selection (Miltenyi #130-092-012). The remaining cell population was resuspended in a FACS buffer. 100,000 cells per well were plated in a V-bottom 96-well plate, and incubated on ice for one hour with TBMs of Example 1 at 1 ug/mL. Following two washes with FACS buffer, the cells were incubated with Alexa-647 labeled anti-human Fc secondary antibody (Jackson Immuno #109-605-098) and cyno cross reactive FITC mouse anti-human CD20 antibody (BD Pharmingen #556632) for one hour on ice. Following two washes with FACS buffer, cells were resuspended in 100 µL of buffer and data was collected on a Beckman Coulter Cytoflex. Cells were analyzed using CytExper v2.3 and gated through CD20 positive population.

8.5.2. Results

Due to their proximal evolutionary relationship to humans, cynomolgus monkeys are the most appropriate preclinical model to analyze the therapeutic effect and potential toxicity of antibody therapeutics, and therefore it is useful for antibodies in clinical development to bind to cynomolgus homolog of their human target. As shown in FIGS. 7A-7B, both the NEG258- and NEG-218 TBMs bind to cyno B cells, indicating that the CD19 binding arm recognizes cyno CD19.

8.6. Example 6: Ability of TBMs to Induce T Cell Activation Upon Cyno B Cells Depletion in PBMCs

8.6.1. Materials & Methods

An ex vivo cyno B cell depletion assay was conducted to measure the ability of NEG258-based TBMs of Example 1 to lyse CD20 positive B cells in PBMCs (peripheral blood mononuclear cells). In brief, PBMCs were isolated from cynomolgus (cyno) monkey whole blood (BiolVT) using ficoll gradient centrifugation. Isolated PBMCs and serial diluted TBMs were seeded on 96-well flat-bottom microtiter plate. Plates were incubated in a 37° C. incubator with 5% CO2 overnight. After 24 h of incubation, samples were harvested and simultaneously stained for CD3 and CD20 to identify B and T cells within the PBMC population. To allow quantitative analysis of the cell population, 75,600 counting beads were added prior to the acquisition by flow cytometry. For each sample, 20,000 beads were acquired in order to determine the absolute numbers of B cells. The percent B cell depletion was determined by calculation of the ratio between the number of B cells and the number of beads. For detection of T cell activation, the cells were stained with anti-CD3, anti-CD69 and anti-CD25 (Biolegend and BD Biosciences).

8.6.2. Results

Both NEG258-based TBMs depleted cyno B cells (FIG. 8A) and induced activation of CD3+ T cells as evidence by upregulation of CD69 and CD25 expression (FIGS. 8C-8H). As expected, neither B cell depletion nor T cell activation occurred in the absence of added TBM. These results show both the ability of the NEG258-based TBMs induce activation of cyno T cells as well as the specificity of the activation.

8.7. Example 7: Re-Directed T Cell Cytotoxicity by CD19 TBMs

NEG258- and NEG218 based TBMs of Example 1 (having CD3 ABMs with the VH and VL domains of an anti-CD3 antibody having an affinity to CD3 of 16 nM as measured by Biacore) were analyzed for their potential to induce T cell-mediated apoptosis in tumor target cells.

8.7.1. Materials and Methods

In one study, the TBMs were compared across multiple donor effector cells. Briefly, huCD19-expressing Nalm6 or Karpas422 target cells were engineered to overexpress firefly luciferase. Cells were harvested and resuspended in RPMI medium (Invitrogen #11875-093) with 10% FBS. 2,500 target cells per well were plated in a flat-bottom 384-well plate. Human pan T effector cells were isolated via MACS negative selection (Miltenyi Biotec #130-096-535) from two donors from cryopreserved PBMC (Cellular Technologies Limited #CTL-UP1) then added to the plate to obtain a final E:T ratio of 3:1 or 5:1. Co-cultured cells were incubated with a serial dilution of all constructs and controls. For normalization, average maximum luminescence refers to target cells co-incubated with effector cells, but without any test construct. After an incubation of 24, 48, 72 or 96 hr at 37° C., 5% CO2, OneGlo luciferase substrate (Promega #E6120) was added to the plate. Luminescence was measured on an Envision plate reader after a 10 minute incubation. Percent specific lysis was calculated using the following equation: Specific lysis (%)=(1−(sample luminescence/average maximum luminescence))*100

8.7.2. Results

As shown in FIGS. 9A-9P, the TBMs show cytotoxic activity against both Nalm6 target cells (FIGS. 9A-9H) and Karpas422 cells (FIGS. 9I-P) at multiple time points, E:T ratios and effector T cell donors. The NEG258-based TBM appears to be more potent than the NEG218-based TBM.

8.8. Example 8: Re-Directed T Cell Cytotoxicity by TBMs with Different CD3 Affinities The NEG258-based TBMs of Example 1 with CD3 ABMs (comprising the VH and VL domains of anti-CD3 antibodies having affinities to CD3 of 16 nM, 30 nM and 48 nM as measured by Biacore) were analyzed for their potential to induce T cell-mediated apoptosis in tumor target cells.

8.8.1. Materials and Methods

In one study, the TBMs were compared across multiple donor effector cells. Briefly, huCD19-expressing Nalm6 and Karpas422 target cells were engineered to overexpress firefly luciferase. Cells were harvested and resuspended in RPMI medium (Invitrogen #11875-093) with 10% FBS. 2,500 target cells per well were plated in a flat-bottom 384-well plate. Human pan T effector cells were isolated via MACS negative selection (Miltenyi Biotec #130-096-535) from two donors from cryopreserved PBMCs (Cellular Technologies Limited #CTL-UP1), then added to the plate to obtain a final E:T ratio of 3:1 or 5:1. Co-cultured cells were incubated with serial dilutions of a TBM or control. For normalization, average maximum luminescence refers to target cells co-incubated with effector cells, but without any test construct. After an incubation of 24, 48, 72 or 96 hr at 37° C., 5% CO2, OneGlo luciferase substrate (Promega #E6120) was added to the plate. Luminescence was measured on an Envision plate reader after a 10 minute incubation. Percent specific lysis was calculated using the following equation: Specific lysis (%)=(1−(sample luminescence/average maximum luminescence))*100

8.8.2. Results

As shown in FIGS. 10A-10P, the TBMs show cytotoxic activity against both Nalm6 target cells (FIGS. 10A-10H) and Karpas422 (FIGS. 10I-10P) at multiple time points, E:T ratios and effector T cell donors.

8.9. Example 9: RTCC Activity of the NEG258-Based TBMs Vs. BBMs and TBMs that do not Bind to CD2

The NEG258-based TBMs of Example 1 containing either a CD2 binding arm or a control lysozyme binding arm were compared for their potential to induce T cell-mediated apoptosis in Nalm6 or Karpas422 target cells target cells. The study also included blinatumomab as a control. Blinatumomab is a bispecific T cell engager, or BiTE, that binds to both CD19 and CD3 but lacks an Fc domain (see, e.g., U.S. Pat. No. 10,191,034).

8.9.1. Materials and Methods

The purified TBMs were compared across multiple donor effector cells. Briefly, huCD19-expressing Nalm6 and Karpas422 target cells were engineered to overexpress firefly luciferase. Cells were harvested and resuspendend in RPMI medium (Invitrogen #11875-093) with 10% FBS. 5,000 target cells per well were plated in a flat-bottom 384-well plate. Human pan T effector cells were isolated via negative selection (Stemcell Technologies #17951) from two donors from cryopreserved PBMCs that were separated from a leukopak (Hemacare #PB001F-1) by Ficoll density gradient centrifugation. Purified T cells were then added to the plate to obtain a final E:T ratio of 3:1, 1:1, 1:3 or 1:5. Co-cultured cells were incubated with serial dilutions of all constructs and controls. For normalization, average maximum luminescence refers to target cells co-incubated with effector cells, but without any test construct. After an incubation of 48, 72 or 96 hr at 37° C., 5% CO2, OneGlo luciferase substrate (Promega #E6120) was added to the plate. Luminescence was measured on an Envision plate reader after a 10 minute incubation. Percent specific lysis was calculated using the following equation: Specific lysis (%)=(1−(sample luminescence/average maximum luminescence))*100

8.9.2. Results

As shown in FIGS. 11A-11L, both types of TBMs show cytotoxic activity against both Nalm6 target cells (FIGS. 11A-11H) and Karpas422 cells (FIGS. 11I-11L). The TBM containing a CD2 binding arm demonstrated superior cytotoxic activity compared to the TBM with a lysozyme binding arm and to blinatumomab, particularly at lower E:T ratios.

8.10. Example 10: Cytokine Release Assay

The NEG258- and NEG218-based TBMs of Example 1 were analyzed for their ability to induce T cell-mediated de novo secretion of cytokines in the presence of tumor target cells.

8.10.1. Materials and Methods

Briefly, huCD19-expressing Nalm6 target cells were harvested and resuspended in RPMI medium with 10% FBS. 20,000 target cells per well were plated in a flat-bottom 96-well plate. Human pan T effector cells were isolated via MACS negative selection from cryopreserved PBMC then added to the plate to obtain a final E:T ratio of 5:1. Co-cultured cells were incubated with serial dilutions of all constructs and controls. After an incubation of 24 hr at 37° C., 5% CO2, the supernatants were harvested by centrifugation at 300×g for 5 min for subsequent analysis.

A multiplexed ELISA was performed according to the manufacturer's instructions using a V-PLEX Proinflammatory Panel 1 Kit (MesoScale Discovery #K15049D).

8.10.2. Results

As shown in FIGS. 12A-12C, both NEG258- and NEG218-based TBMs induce significant cytokine secretion by T cells at all dose levels measured. These figures indicate that they can be effective at lower doses.

8.11. Example 11: Binding of NEG258- and NEG218-Based TBMs to Human and Cyno CD19

8.11.1. Materials and Methods

The mouse cell line 300.19 was engineered to overexpress either human CD19 or cyno CD19. Cells were cultured in in RPMI medium (Invitrogen #11875-093) with 10% FBS and 2-mercaptoethanol. Cells were harvested and resuspended in FACS buffer (PBS containing 1% FBS). 50,000 cells per well were plated in a V-bottom 96-well plate. Each cell line was incubated with serial dilutions of TBMs of Example 1 for one hour on ice. Cells were centrifuged for 4 min at 400×g and washed with FACS buffer. This was repeated twice, and then the cells were incubated with Alexa-647 labeled anti-human Fc secondary antibody (Jackson Immuno #109-605-098) for 30 min on ice. The cells were washed twice, then resuspended in 100 μL of FACS buffer. FACS data was collected on a Beckman Coulter Cytoflex and analysis was performed using CytExpert v2.3.

8.11.2. Results

As shown in FIGS. 13A-13B, the NEG258- and NEG218-based TBMs bind to cell lines engineered to overexpress both human and cyno CD19. NEG258 appears to bind equally to both human and cyno while NEG218 appears to have greater affinity for cyno CD19 than human CD19. Of the two, NEG258 appears to have greater affinity for both human CD19 and cyno CD19.

8.12. Example 12: Engineering CD58 for Improved Stability

8.12.1. Background

Human CD58 contains a signal peptide of 29 amino acids and two Ig-like domains. The most N-terminal Ig-like domain, referred to as domain 1, is of V-type, similar to a variable region of an antibody, and the second domain, named domain 2, is of C-type, is similar to a constant regions of an antibody. A schematic overview of the CD58 domain structure is shown in FIG. 14.

As illustrated in Examples 1-11, domain 1 of CD58, which interacts with CD2, can be used in lieu of an anti-CD2 antibody binding fragment in multispecific binding molecules. However, CD58 exhibits lower stability than immunoglobulins.

In order to improve stability of human CD58 domain 1, the protein was engineered to include a pair of cysteine that form a disulfide bridge upon expression to stabilize the molecule.

Four different pairs of amino acids were engineered to be replaced by cysteines: (1) V45 and M105, (2) V45 and M114, (3) V54 and G88 and (4) W56 and L90.

8.12.2. Materials and Methods 8.12.2.1. Recombinant Expression

To assess the binding and biophysical characteristics, the CD58 disulfide variants were transiently produced and purified from HEK293 cells along with the CD2 extracellular domain. All plasmids were codon optimized for mammalian expression. Human and cyno CD2 constructs were produced with a C-terminal Avi-Tag and a N terminal 8×his tag (SEQ ID NO: 1017) followed by a EVNLYFQS sequence (SEQ ID NO: 1018) for cleavage of the histag after purification. CD2 constructs were site selectively biotinylated during expression via co-transfection of a plasmid encoding the BirA enzyme. CD58 was expressed with a C-terminal 8×his tag (SEQ ID NO: 1017). Transient expression and purification in HEK293F cells was performed with standard methodology. The sequences are shown in Table 21.

For expression, transfection was performed using PEI as transfection reagent. For small scale (<5L) transfections, cells were grown in shake flasks on an orbital shaker (100 rpm) in a humidified incubator (85%) at 8% CO2). Transfection was done with a ratio of 1 DNA:3 PEI. 1 mg/L culture of plasmid was used for transfection at 2.0 million cells/mL in Expi293 medium. After 5 days of expression, the culture was centrifuged and filtrated. Purification was performed via Nickel-NTA batch binding using 1 ml resin/100 mL supernatant. The protein was allowed to bind for a minimum of 2 hours with gentle mixing, and the mixture was loaded onto a gravity filtration column. The resin was washed with 30 CV of PBS. Proteins were eluted with imidazole. The eluted protein was concentrated and finally purified via a preparative size exclusion chromatography (Hi Load 16/60 Superdex 75 grade column, GE Healthcare Life Sciences, Uppsala, Sweden). To confirm that the identity of the proteins expressed matched the predicted masses for the primary amino acid sequences, proteins were analyzed by high-performance liquid chromatography coupled to mass spectrometry.

8.12.2.2. Stability

Disulfide stabilized variants were assessed for improved thermal stability using both differential scanning calorimetry (DSC) and differential scanning fluorimetry (DSF) using standard techniques. For DSF, 1-3 ug of each construct was add to 1× Sypro Orange (Thermo-Fisher) in 25 ul total volume in 96-well PCR plate. Using a Bio-Rad CFX96 RT-PCR system equipped with C1000 Thermal Cycler, the temperature was increased from 25° C. to 95° C. at 0.5°

TABLE 21

| Protein Name | AA Sequence | SEQ ID NO: |
|---|---|---|
| Human CD2 | SKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDGGGGSGLNDIFEAQKIEWHE | 1019 |
| Cyno CD2 | SKEIRNALETWGALGQDIDLDIPSFQMSDDIDDIRWEKTSDKKKIAQFRKEKETFEEKDAYKLFKNGTLKIKHLKIHDQDSYKVSIYDTKGKNVLEKTFDLKIQERVSEPKISWTCINTTLTCEVMNGTDPELNLYQDGKHVKLSQRVITHKWTTSLSAKFKCTAGNKVSKESRMETVSCPEKGLDGGGGSGLNDIFEAQKIEWHE | 1020 |
| CD58 Full ECD | SQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRGGGGSHHHHHHHH | 1021 |
| CD58_IgV | SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSHHHHHHHH | 1022 |
| IgV V45C_M105C | SQQIYGVVYGNVITHCPSNVPLKEVLWKKQKDKVAELENSEFRAFSSFKNRVYLDTVSGSLTIYNLTSSDEDEYECESPNITDTMKFFLYVLESGGGGSHHHHHHHH | 1023 |
| IgV V54C_G88C | SQQIYGVVYGNVTFHVPSNVPLKECLWKKQKDKVAELENSEFRAFSSFKNRVYLDTVSCSLTIYNLTSSDEDEYEMESPNITDTMKFFLYVLESGGGGSHHHHHHHH | 1024 |
| IgV V45C_M114C | SQQIYGVVYGNVTFHCPSNVPLKEVLWKKQKDKVAELENSEFRAFSSFKNRVYLDTVSGSLTIYNLTSSDEDEYEMESPNITDTCKFFLYVLESGGGGSHHHHHHHH | 1025 |

C./minute and the fluorescence monitored. The manufacturer-supplied software was used to determine Tm.

For DSC, all samples were dialyzed into HEPES-buffered saline (HBS) and diluted to final concentration of 0.5 mg/mL. Tm and Tonset were determined using a MicroCal VP-Capillary DSC system (Malvern) by increasing temperature from 25° C. to 100° C. at 1° C./minute with a filtering period of 2 seconds and a mid-gain setting.

8.12.2.3. Binding Affinity

To ensure the binding affinity remained uncompromised by the additional of the stabilizing disulfide variance, isothermal calorimetry (ITC) was performed on the resulting recombinant CD58 proteins to determine their apparent KD and binding stoichiometry (n) to recombinant human CD2.

Briefly, recombinant human CD2 and recombinant human CD58 variants were dialyzed into HEPES-buffered saline (HBS). CD2 was diluted to final concentration of 100 µM, CD58 variants were diluted to 10 µM. CD2 was titrated into 10 µM of CD58 variants via multiple injections and ΔH (kcal/mole) determined using a MicroCal VP-ITC isothermal titration calorimeter (Malvern). Titrations of CD2 into HBS were used as a reference and KD and n determined from the resulting data.

8.12.3. Results

Results for both DSF and DSC measurements for the constructs are shown in Table 22 below.

TABLE 22

| CD58 variant | By Differential Scanning Fluorimetry (DSF) | By Differential Scanning Calorimetry (DSC) | |
|---|---|---|---|
| | Tm (° C.) | Tmonset (° C.) | Tm (° C.) |
| CD58 Full ECD | 59.5 | 48.8 | 65.0 |
| CD58_IgV | 48.5 | 46.3 | 60.9 |
| IgV V45C_M105C | 48.5 | 43.9 | 66.8 |
| IgV V54C_G88C | 76.5 | 66.7 | 80.9 |
| IgV V45C_M114C | 63.5 | 49.6 | 72.5 |

Results of the affinity studies are shown in Table 23 below. Addition of stabilizing disulfide had no detrimental impact on the affinity or the binding stoichiometry.

TABLE 23

| CD58 variant | KD (uM) | n |
|---|---|---|
| CD58 Full ECD | 0.57 (±0.05) | 0.92 (±0.01) |
| CD58_IgV | 0.61 (±0.07) | 0.96 (±0.01) |
| IgV V45C_M105C | 0.88 (±0.06) | 0.97 (±0.01) |
| IgV V54C_G88C | 0.60 (±0.06) | 0.83 (±.0.01) |
| IgV V45C_M114C | 0.38 (±0.03) | 0.88 (±.0.01) |

8.13. Example 13: Production of Anti-CD3-Anti-CD19-CD58 IgG1 TBMs in Knob-into-Holes Format 8.13.1. Materials and Methods Constructs were synthesized and codon optimized for expression in mammalian cells. For each trispecific construct, three plasmids were synthesized. A first plasmid encoding an anti-CD19 heavy chain was synthesized as a fusion comprising (in the N-terminal to C-terminal direction) (i) a VH domain fused to a constant hIgG1 CH1 domain, (ii) a linker, (iii) an anti-CD3 scFv, (iv) a second linker and (v) a hIgG1 Fc domain containing mutations for a hole to facilitate heterodimerization as well as silencing mutations. A second plasmid encoding a light chain was synthesized as a fusion comprising (in the N-terminal to C-terminal direction) an anti-CD19 VL domain and (ii) a constant human kappa sequence. A third plasmid encoding a second half antibody was synthesized as a fusion comprising (in the N-terminal to C-terminal direction) a CD58 disulfide stabilized variant fused to a constant hIgG1 domain containing mutations for a knob to facilitate heterodimerization as well as silencing mutations. The sequences are shown in Table 24.

TABLE 24

| Trispecific Name | Chain Description | Sequence | SEQ ID NO: |
|---|---|---|---|
| CD19_CTL119_CD3_16 nM-CD58_Full ECD Trispecific | First Half Antibody Heavy Chain (Fc sequence not shown) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGS | 1026 |
| | First Half Antibody Heavy Chain (includes Fc sequence) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED | 1330 |

TABLE 24-continued

| Trispecific Name | Chain Description | Sequence | SEQ ID NO: |
|---|---|---|---|
| | | TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGSDKTHTCPPCPAPELLGGPSVFLFP PKPKDTLMISRTPEVTCVVVAVSHEDPEVKFNW YVDGVEVHNAKTKPREEQYGSTYRVVSVLTVLH QDWLNGKEYKCKVSNKALAAPIEKTISKAKGQP REPQVCTLPPSRDELTKNQVSLSCAVKGFYPSD IAVEWESNGQPENNYKTTPPVLDSDGSFFLVSK LTVDKSRWQQGNVFSCSVMHEALHNHYTQKSL SLSPGK | |
| | Second Half Antibody (Fc sequence not shown) | FSQQIYGVVYGNVTFHVPSNVPLKEVLWKKQKD KVAELENSEFRAFSSFKNRVYLDTVSGSLTIYNL TSSDEDEYEMESPNITDTMKFFLYVLESLPSPTL TCALTNGSIEVQCMIPEHYNSHRGLIMYSWDCP MEQCKRNSTSIYFKMENDLPQKIQCTLSNPLFN TTSSIILTTCIPSSGHSRHRGGGS | 1027 |
| | Second Half Antibody (includes Fc sequence) | FSQQIYGVVYGNVTFHVPSNVPLKEVLWKKQKD KVAELENSEFRAFSSFKNRVYLDTVSGSLTIYNL TSSDEDEYEMESPNITDTMKFFLYVLESLPSPTL TCALTNGSIEVQCMIPEHYNSHRGLIMYSWDCP MEQCKRNSTSIYFKMENDLPQKIQCTLSNPLFN TTSSIILTTCIPSSGHSRHRGGGSDKTHTCPPCP APELLGGPSVFLFPPKPKDTLMISRTPEVTCVVV DVSHEDPEVKFNWYVDGVEVHNAKTKPREEQY ASTYRVVSVLTVLHQDWLNGKEYKCKVSNKALP APIEKTISKAKGQPREPQVYTLPPCREEMTKNQ VSLWCLVKGFYPSDIAVEWESNGQPENNYKTT PPVLDSDGSFFLYSKLTVDKSRWQQGNVFSCS VMHEALHNRYTQKSLSLSPGK | 1331 |
| | First Half Antibody Light Chain | EIVMTQSPATLSLSPGERATLSCRASQDISKYLN WYQQKPGQAPRLLIYHTSRLHSGIPARFSGSGS GTDYTLTISSLQPEDFAVYFCQQGNTLPYTFGQ GTKLEIKRTVAAPSVFIFPPSDEQLKSGTASVVC LLNNFYPREAKVQWKVDNALQSGNSQESVTEQ DSKDSTYSLSSTLTLSKADYEKHKVYACEVTHQ GLSSPVTKSFNRGEC | 1028 |
| CD19_CTL119 _CD3_16 nM- CD58_IgV Trispecific | First Half Antibody Heavy Chain (Fc sequence not shown) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGS | 1026 |
| | First Half Antibody Heavy Chain (includes Fc sequence) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGSDKTHTCPPCPAPELLGGPSVFLFP PKPKDTLMISRTPEVTCVVVAVSHEDPEVKFNW | 1330 |

TABLE 24-continued

| Trispecific Name | Chain Description | Sequence | SEQ ID NO: |
|---|---|---|---|
| | | YVDGVEVHNAKTKPREEQYGSTYRVVSVLTVLH QDWLNGKEYKCKVSNKALAAPIEKTISKAKGQP REPQVCTLPPSRDELTKNQVSLSCAVKGFYPSD IAVEWESNGQPENNYKTTPPVLDSDGSFFLVSK LTVDKSRWQQGNVFSCSVMHEALHNHYTQKSL SLSPGK | |
| | Second Half Antibody (Fc sequence not shown) | SQQIYGVVYGNVTFHVPSNVPLKEVLWKKQKD KVAELENSEFRAFSSFKNRVYLDTVSGSLTIYNL TSSDEDEYEMESPNITDTMKFFLYVLESGGGGS | 1008 |
| | Second Half Antibody (includes Fc sequence) | SQQIYGVVYGNVTFHVPSNVPLKEVLWKKQKD KVAELENSEFRAFSSFKNRVYLDTVSGSLTIYNL TSSDEDEYEMESPNITDTMKFFLYVLESGGGGS DKTHTCPPCPAPELLGGPSVFLFPPKPKDTLMIS RTPEVTCVVVAVSHEDPEVKFNWYVDGVEVHN AKTKPREEQYASTYRVVSVLTVLHQDWLNGKE YKCKVSNKALAAPIEKTISKAKGQPREPQVYTLP PCREEMTKNQVSLWCLVKGFYPSDIAVEWESN GQPENNYKTTPPVLDSDGSFFLYSKLTVDKSR WQQGNVFSCSVMHEALHNRYTQKSLSLSPGK | 1322 |
| | First Half Antibody Light Chain | EIVMTQSPATLSLSPGERATLSCRASQDISKYLN WYQQKPGQAPRLLIYHTSRLHSGIPARFSGSGS GTDYTLTISSLQPEDFAVYFCQQGNTLPYTFGQ GTKLEIKRTVAAPSVFIFPPSDEQLKSGTASVVC LLNNFYPREAKVQWKVDNALQSGNSQESVTEQ DSKDSTYSLSSTLTLSKADYEKHKVYACEVTHQ GLSSPVTKSFNRGEC | 1028 |
| CD19_CTL119 _CD3_16 nM- CD58_IgV_ V45C_M105C Trispecific | First Half Antibody Heavy Chain (Fc sequence not shown) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGS | 1026 |
| | First Half Antibody Heavy Chain (includes Fc sequence) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGSDKTHTCPPCPAPELLGGPSVFLFP PKPKDTLMISRTPEVTCVVVAVSHEDPEVKFNW YVDGVEVHNAKTKPREEQYGSTYRVVSVLTVLH QDWLNGKEYKCKVSNKALAAPIEKTISKAKGQP REPQVCTLPPSRDELTKNQVSLSCAVKGFYPSD IAVEWESNGQPENNYKTTPPVLDSDGSFFLVSK LTVDKSRWQQGNVFSCSVMHEALHNHYTQKSL SLSPGK | 1330 |

TABLE 24-continued

| Trispecific Name | Chain Description | Sequence | SEQ ID NO: |
|---|---|---|---|
| | Second Half Antibody (Fc sequence not shown) | SQQIYGVVYGNVTFHCPSNVPLKEVLWKKQKD KVAELENSEFRAFSSFKNRVYLDTVSGSLTIYNL TSSDEDEYECESPNITDTMKFFLYVLESGS | 1029 |
| | Second Half Antibody (includes Fc sequence) | SQQIYGVVYGNVTFHCPSNVPLKEVLWKKQKD KVAELENSEFRAFSSFKNRVYLDTVSGSLTIYNL TSSDEDEYECESPNITDTMKFFLYVLESGSDKT HTCPPCPAPELLGGPSVFLFPPKPKDTLMISRTP EVTCVVVDVSHEDPEVKFNWYVDGVEVHNAKT KPREEQYASTYRVVSVLTVLHQDWLNGKEYKC KVSNKALPAPIEKTISKAKGQPREPQVYTLPPCR EEMTKNQVSLWCLVKGFYPSDIAVEWESNGQP ENNYKTTPPVLDSDGSFFLYSKLTVDKSRWQQ GNVFSCSVMHEALHNRYTQKSLSLSPGK | 1332 |
| | First Half Antibody Light Chain | EIVMTQSPATLSLSPGERATLSCRASQDISKYLN WYQQKPGQAPRLLIYHTSRLHSGIPARFSGSGS GTDYTLTISSLQPEDFAVYFCQQGNTLPYTFGQ GTKLEIKRTVAAPSVFIFPPSDEQLKSGTASVVC LLNNFYPREAKVQWKVDNALQSGNSQESVTEQ DSKDSTYSLSSTLTLSKADYEKHKVYACEVTHQ GLSSPVTKSFNRGEC | 1028 |
| CD19_CTL119 _CD3_16 nM- CD58_IgV V54C_G88C Trispecific | First Half Antibody Heavy Chain (Fc sequence not shown) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGS | 1026 |
| | First Half Antibody Heavy Chain (includes Fc sequence) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGSDKTHTCPPCPAPELLGGPSVFLFP PKPKDTLMISRTPEVTCVVVAVSHEDPEVKFNW YVDGVEVHNAKTKPREEQYGSTYRVVSVLTVLH QDWLNGKEYKCKVSNKALAAPIEKTISKAKGQP REPQVCTLPPSRDELTKNQVSLSCAVKGFYPSD IAVEWESNGQPENNYKTTPPVLDSDGSFFLVSK LTVDKSRWQQGNVFSCSVMHEALHNHYTQKSL SLSPGK | 1330 |
| | Second Half Antibody (Fc sequence not shown) | SQQIYGVVYGNVTFHVPSNVPLKECLWKKQKD KVAELENSEFRAFSSFKNRVYLDTVSCSLTIYNL TSSDEDEYEMESPNITDTMKFFLYVLESGS | 1030 |

TABLE 24-continued

| Trispecific Name | Chain Description | Sequence | SEQ ID NO: |
|---|---|---|---|
| | Second Half Antibody (includes Fc sequence) | SQQIYGVVYGNVTFHVPSNVPLKECLWKKQKD KVAELENSEFRAFSSFKNRVYLDTVSCSLTIYNL TSSDEDEYEMESPNITDTMKFFLYVLESGSDKT HTCPPCPAPELLGGPSVFLFPPKPKDTLMISRTP EVTCVVVDVSHEDPEVKFNWYVDGVEVHNAKT KPREEQYASTYRVVSVLTVLHQDWLNGKEYKC KVSNKALPAPIEKTISKAKGQPREPQVYTLPPCR EEMTKNQVSLWCLVKGFYPSDIAVEWESNGQP ENNYKTTPPVLDSDGSFFLYSKLTVDKSRWQQ GNVFSCSVMHEALHNRYTQKSLSLSPGK | 1333 |
| | First Half Antibody Light Chain | EIVMTQSPATLSLSPGERATLSCRASQDISKYLN WYQQKPGQAPRLLIYHTSRLHSGIPARFSGSGS GTDYTLTISSLQPEDFAVYFCQQGNTLPYTFGQ GTKLEIKRTVAAPSVFIFPPSDEQLKSGTASVVC LLNNFYPREAKVQWKVDNALQSGNSQESVTEQ DSKDSTYSLSSTLTLSKADYEKHKVYACEVTHQ GLSSPVTKSFNRGEC | 1028 |
| CD19_CTL119 _CD3_16 nM-CD58_IgV V45C_M114C Trispecific | First Half Antibody Heavy Chain (Fc sequence not shown) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPVVTPARFSGSLLGDKA ALTLSGAQPEDEAEYFCALWYSNLWVFGGGTK LTVLGGGGS | 1026 |
| | First Half Antibody Heavy Chain (includes Fc sequence) | QVQLQESGPGLVKPSETLSLTCTVSGVSLPDYG VSWIRQPPGKGLEWIGVIWGSETTYYQSSLKSR VTISKDNSKNQVSLKLSSVTAADTAVYYCAKHY YYGGSYAMDYWGQGTLVTVSSASTKGPSVFPL APSSKSTSGGTAALGCLVKDYFPEPVTVSWNS GALTSGVHTFPAVLQSSGLYSLSSVVTVPSSSL GTQTYICNVNHKPSNTKVDKRVEPKSCGGGGS GGGGSEVQLVESGGGLVQPGGSLKLSCAASGF TFNTYAMNWVRQASGKGLEWVGRIRSKYNNYA TYYADSVKDRFTISRDDSKSTLYLQMNSLKTED TAVYYCVRHGNFGNSYVSWFAYWGQGTLVTVS SGGGGSGGGGSGGGGSGGGGSQAVVTQEPS LTVSPGGTVTLTCRSSTGAVTTSNYANWVQQK PGQAPRGLIGGTNKRAPWTPARFSGSLLGDKA ALTLSGAQPEDEAEYFCALWYSNLWVFGGGTK LTVLGGGGSDKTHTCPPCPAPELLGGPSVFLFP PKPKDTLMISRTPEVTCVVVAVSHEDPEVKFNW YVDGVEVHNAKTKPREEQYGSTYRVVSVLTVLH QDWLNGKEYKCKVSNKALAAPIEKTISKAKGQP REPQVCTLPPSRDELTKNQVSLSCAVKGFYPSD IAVEWESNGQPENNYKTTPPVLDSDGSFFLVSK LTVDKSRWQQGNVFSCSVMHEALHNHYTQKSL SLSPGK | 1330 |
| | Second Half Antibody (Fc sequence not shown) | SQQIYGVVYGNVTFHCPSNVPLKEVLWKKQKD KVAELENSEFRAFSSFKNRVYLDTVSGSLTIYNL TSSDEDEYEMESPNITDTCKFFLYVLESGS | 1031 |
| | Second Half Antibody (includes Fc sequence) | SQQIYGVVYGNVTFHCPSNVPLKEVLWKKQKD KVAELENSEFRAFSSFKNRVYLDTVSGSLTIYNL TSSDEDEYEMESPNITDTCKFFLYVLESGSDKT HTCPPCPAPELLGGPSVFLFPPKPKDTLMISRTP EVTCVVVDVSHEDPEVKFNWYVDGVEVHNAKT KPREEQYASTYRVVSVLTVLHQDWLNGKEYKC KVSNKALPAPIEKTISKAKGQPREPQVYTLPPCR EEMTKNQVSLWCLVKGFYPSDIAVEWESNGQP ENNYKTTPPVLDSDGSFFLYSKLTVDKSRWQQ GNVFSCSVMHEALHNRYTQKSLSLSPGK | 1334 |

TABLE 24-continued

| Trispecific Name | Chain Description | Sequence | SEQ ID NO: |
|---|---|---|---|
| | First Half Antibody Light Chain | EIVMTQSPATLSLSPGERATLSCRASQDISKYLN WYQQKPGQAPRLLIYHTSRLHSGIPARFSGSGS GTDYTLTISSLQPEDFAVYFCQQGNTLPYTFGQ GTKLEIKRTVAAPSVFIFPPSDEQLKSGTASVVC LLNNFYPREAKVQWKVDNALQSGNSQESVTEQ DSKDSTYSLSSTLTLSKADYEKHKVYACEVTHQ GLSSPVTKSFNRGEC | 1028 |

Trispecific binding molecules were expressed transiently by co-transfection of the respective chains in HEK293 cells. Briefly, transfection was performed using PEI as transfection reagent. For small scale (<5L) transfections, cells were grown in shake flasks on an orbital shaker (115 rpm) in a humidified incubator (85%) at 5% CO2). Plasmids were combined with PEI at a final ratio of 1 DNA:3 PEI. 1 mg/L culture of plasmid was used for transfection at 2.0 million cells/mL serum media. After 5 days of expression, the TBMs were harvested by clarification of the media via centrifugation and filtration. Purification was performed via anti-CH1 affinity batch binding (CaptureSelect IgG-CH1 Affinity Matrix, Thermo-Fisher Scientific, Waltham, MA, USA) or Protein A (rProteinA Sepharose, Fast flow, GE Healthcare, Uppsala, Sweden) batch binding using 1 ml resin/100 mL supernatant. The protein was allowed to bind for a minimum of 2 hours with gentle mixing, and the supernatant loaded onto a gravity filtration column. The resin was washed with 20-50 CV of PBS. TBMs were eluted with 20 CV of 50 mM citrate, 90 mM NaCl pH 3.2. 50 mM sucrose The eluted TBMs were adjusted to pH 5.5 with 1 M sodium citrate 50 mM sucrose. Preparative size exclusion chromatography was performed using Hi Load 16/60 Superdex 200 grade column (GE Healthcare Life Sciences, Uppsala, Sweden) as a final polishing step when aggregates were presented. To confirm that the identity of the proteins of the TBMs expressed matched the predicted masses for the primary amino acid sequences, proteins were analyzed by high-performance liquid chromatography coupled to mass spectrometry.

8.13.2. Results

As shown in Table 25 below, inclusion of stabilizing disulfide variants had no adverse impact on overall expression yields of increased aggregate content upon purification.

TABLE 25

| | Expression (mg/L) | % HMWS |
|---|---|---|
| CD19_CTL119_CD3_16 nM-CD58_Full ECD Trispecific (Full ECD WT) | 20 | <10% |
| CD19_CTL119_CD3_16 nM-CD58_IgV Trispecific (IgV WT) | 20 | ~10 |
| CD19_CTL119_CD3_16 nM-CD58_IgV_V45C_M105C Trispecific (IgV V45C_M105C) | 55 | ~10 |
| CD19_CTL119_CD3_16 nM-CD58_IgV V54C_G88C Trispecific (IgV V54C_G88C) | 65 | ~10 |
| CD19_CTL119_CD3_16 nM-CD58_IgV V45C_M114C Trispecific (IgV V45C_M114C) | 63 | ~10 |

8.14. Example 14: Re-Directed T Cell Cytotoxicity with TBMs Containing CD58 Variants TBMs of Example 13 containing the variant CD58 domains were analyzed for their potential to induce T cell-mediated apoptosis in tumor target cells.

8.14.1. Materials and Methods

Briefly, huCD19-expressing Nalm6 target cells were engineered to overexpress firefly luciferase. Cells were harvested and resuspendend in RPMI medium (Invitrogen #11875-093) with 10% FBS. 10,000 target cells per well were plated in a flat-bottom 96-well plate. Human pan T effector cells were isolated via MACS negative selection (Miltenyi Biotec #130-096-535) from two donors from cryopreserved PBMC (Cellular Technologies Limited #CTL-UP1) then added to the plate to obtain a final E:T ratio of 5:1. Co-cultured cells were incubated with a serial dilution of all constructs and controls. For normalization, average maximum luminescence refers to target cells co-incubated with effector cells, but without any test construct. After an incubation of either 24 or 48 hr at 37° C., 5% CO2, OneGlo luciferase substrate (Promega #E6120) was added to the plate. Luminescence was measured on an Envision plate reader after a 10 minute incubation. Percent specific lysis was calculated using the following equation: Specific lysis (%)=(1−(sample luminescence/average maximum luminescence))*100

8.14.2. Results

As shown in FIG. 15, the TBMs containing the variant CD58 domains show comparable cytotoxic activity to a TBM with wild type CD58.

8.15. Example 15: T-Cell Activation with TBMs Containing CD58 Variants

As an alternative to primary T cell activation, a Jurkat-NFAT reporter cell line was used to evaluate the functional activity of the TBMs of Example 13 containing the variant CD58 domains.

8.15.1. Materials and Methods

The Jurkat T cell line (E6-1) was transfected with a NFAT-luciferase reporter construct and a stable, clonal cell line Jurkat cells with NFAT-LUC reporter (JNL), was selected for further characterization based on strong induction of the NFAT reporter following PMA and ionomycin stimulation.

The Jurkat reporter cell line for was used for determination of non-specific activation of N FAT.

Purified TBMs were tested for their potential to induce NFAT activation in the absence of target cells.

Jurkat cells with NFAT-LUC reporter (JNL) were grown in RPMI-1640 media containing 2 mM glutamine and 10% fetal bovine serum with puromycin at 0.5 ug/ml. 100,000 JNL cells per well were plated in a flat-bottom 96-well plate and were incubated with serial dilutions of the TBMs and controls. After an incubation of 6 hr at 37° C., 5% CO2, OneGlo luciferase substrate (Promega #E6120) was added to the plate. Luminescence was measured on an Envision plate reader after a 10 minute incubation.

8.15.2. Results

As shown in FIG. 16, the TBMs containing the variant CD58 domains show tumor-independent (i.e., non-target cell specific) activation levels comparable to or lower than TBMs containing wild type CD58.

9. SPECIFIC EMBODIMENTS, CITATION OF REFERENCES

While various specific embodiments have been illustrated and described, it will be appreciated that various changes can be made without departing from the spirit and scope of the disclosure(s). The present disclosure is exemplified by the numbered embodiments set forth below.

1. A CD2 binding molecule comprising a variant CD58 domain having a pair of cysteine substitutions as compared to the corresponding domain in SEQ ID NO:1, the cysteine substitutions selected from:
   (a) a V45C substitution and a M105C substitution;
   (b) a V54C substitution and a G88C substitution;
   (c) a V45C substitution and a M114C substitution; or
   (d) a W56C substitution and a L900 substitution.

2. The CD2 binding molecule of embodiment 1, wherein the variant CD58 domain comprises an amino acid sequence having at least 90% sequence identity to a CD2-binding portion of SEQ ID NO:1.

3. The CD2 binding molecule of embodiment 1 or embodiment 2 wherein the CD2-binding portion comprises the amino acid sequence of SEQ ID NO:6.

4. The CD2 binding molecule of any one of embodiments 1 to 3, which comprises an amino acid sequence having at least 90% sequence identity to the amino acid sequence of SEQ ID NO:6.

5. The CD2 binding molecule of embodiment 4, which comprises an amino acid sequence having at least 95% sequence identity to the amino acid sequence of SEQ ID NO:6.

6. The CD2 binding molecule of embodiment 5, which comprises an amino acid sequence having at least 97% sequence identity to the amino acid sequence of SEQ ID NO:6.

7. The CD2 binding molecule of embodiment 6, which comprises an amino acid sequence having at least 98% sequence identity to the amino acid sequence of SEQ ID NO:6.

8. The CD2 binding molecule of embodiment 1 or embodiment 2, wherein the CD2-binding portion comprises the amino acid sequence of SEQ ID NO:4.

9. The CD2 binding molecule of embodiment 8, which comprises an amino acid sequence having at least 90% sequence identity to the amino acid sequence of SEQ ID NO:4.

10. The CD2 binding molecule of embodiment 9, which comprises an amino acid sequence having at least 95% sequence identity to the amino acid sequence of SEQ ID NO:4.

11. The CD2 binding molecule of embodiment 10, which comprises an amino acid sequence having at least 97% sequence identity to the amino acid sequence of SEQ ID NO:4.

12. The CD2 binding molecule of embodiment 11, which comprises an amino acid sequence having at least 98% sequence identity to the amino acid sequence of SEQ ID NO:4.

13. The CD2 binding molecule of any one of embodiments 1 to 12, which comprises a V45C substitution and a M105C substitution as compared to the amino acid sequence of SEQ ID NO:1.

14. The CD2 binding molecule of embodiment 8 or embodiment 13, wherein the amino acid sequence comprises the amino acid sequence of SEQ ID NO:8.

15. The CD2 binding molecule of any one of embodiments 1 to 12, which comprises a V54C substitution and a G88C substitution as compared to the amino acid sequence of SEQ ID NO:1.

16. The CD2 binding molecule of embodiment 15, wherein the amino acid sequence comprises the amino acid sequence of SEQ ID NO:9.

17. The CD2 binding molecule of any one of embodiments 1 to 12, which comprises a V45C substitution and a M114C substitution as compared to the amino acid sequence of SEQ ID NO:1.

18. The CD2 binding molecule of embodiment 17, wherein the amino acid sequence comprises the amino acid sequence of SEQ ID NO:10.

19. The CD2 binding molecule of any one of embodiments 1 to 12, which comprises a W56C substitution and a L900 substitution as compared to the amino acid sequence of SEQ ID NO:1.

20. The CD2 binding molecule of embodiment 19, wherein the amino acid sequence comprises the amino acid sequence of SEQ ID NO:11.

21. The CD2 binding molecule of any one of embodiments 1 to 20, which exhibits increased thermostability as compared to the corresponding CD2 binding molecule without the cysteine substitutions.

22. The CD2 binding molecule of any one of embodiments 1 to 21, in which the CD2-binding portion exhibits at least a 10% increase in its Tm as compared to the corresponding CD2-binding portion without the cysteine substitutions.

23. The CD2 binding molecule of embodiment 22, in which the CD2-binding portion exhibits at least a 20% increase in its Tm as compared to the corresponding CD2-binding portion without the cysteine substitutions.

24. The CD2 binding molecule of embodiment 23, in which the CD2-binding portion exhibits at least a 30% increase in its Tm as compared to the corresponding CD2-binding portion without the cysteine substitutions.

25. The CD2 binding molecule of any one of embodiments 22 to 24, wherein Tm is measured by differential scanning fluorimetry.

26. The CD2 binding molecule of any one of embodiments 22 to 24, wherein Tm is measured by differential scanning calorimetry.

27. The CD2 binding molecule of any one of embodiments 1 to 26, which is a fusion polypeptide.

28. The CD2 binding molecule of embodiment 27, in which the CD2-binding portion is operably linked to an Fc domain.

29. The CD2 binding molecule of any one of embodiments 1 to 28, which is a soluble polypeptide.

30. The CD2 binding molecule of any one of embodiments 1 to 26, which is a multispecific binding molecule (MBM) comprising the variant CD58 domain as a first antigen-binding module (ABM1) and a second antigen-binding module (ABM2), optionally wherein ABM2 binds specifically to a component of a human T-cell receptor (TCR) complex or a tumor associated antigen (TAA).

31. The CD2 binding molecule of embodiment 30, wherein ABM2 binds specifically to a component of a human T-cell receptor (TCR) complex.

32. The CD2 binding molecule of embodiment 31, wherein the component of the TCR complex is CD3.

33. The CD2 binding molecule of embodiment 32, wherein ABM2 is an anti-CD3 antibody or an antigen-binding domain thereof.

34. The CD2 binding molecule of embodiment 32, wherein ABM2 comprises the CDR sequences of CD3-1.

35. The CD2 binding molecule of embodiment 32, wherein ABM2 comprises the CDR sequences of CD3-2.

36. The CD2 binding molecule of embodiment 32, wherein ABM2 comprises the CDR sequences of CD3-3.

37. The CD2 binding molecule of embodiment 32, wherein ABM2 comprises the CDR sequences of CD3-4.

38. The CD2 binding molecule of embodiment 32, wherein ABM2 comprises the CDR sequences of CD3-5.

39. The CD2 binding molecule of embodiment 32, wherein ABM2 comprises the CDR sequences of CD3-6.

40. The CD2 binding molecule of embodiment 32, wherein ABM2 comprises the CDR sequences of CD3-7.

41. The CD2 binding molecule of embodiment 32, wherein ABM2 comprises the CDR sequences of CD3-8.

42. The CD2 binding molecule of embodiment 32, wherein ABM2 comprises the CDR sequences of CD3-9.

43. The CD2 binding molecule of embodiment 32, wherein ABM2 comprises the CDR sequences of CD3-10.

44. The CD2 binding molecule of embodiment 32, wherein ABM2 comprises the CDR sequences of CD3-11.

45. The CD2 binding molecule of embodiment 32, wherein ABM2 comprises the CDR sequences of CD3-12.

46. The CD2 binding molecule of embodiment 32, wherein ABM2 comprises the CDR sequences of CD3-13.

47. The CD2 binding molecule of embodiment 32, wherein ABM2 comprises the CDR sequences of CD3-14.

48. The CD2 binding molecule of embodiment 32, wherein ABM2 comprises the CDR sequences of CD3-15.

49. The CD2 binding molecule of embodiment 32, wherein ABM2 comprises the CDR sequences of CD3-16.

50. The CD2 binding molecule of embodiment 32, wherein ABM2 comprises the CDR sequences of CD3-17.

51. The CD2 binding molecule of embodiment 32, wherein ABM2 comprises the CDR sequences of CD3-18.

52. The CD2 binding molecule of embodiment 32, wherein ABM2 comprises the CDR sequences of CD3-19.

53. The CD2 binding molecule of embodiment 32, wherein ABM2 comprises the CDR sequences of CD3-20.

54. The CD2 binding molecule of embodiment 32, wherein ABM2 comprises the CDR sequences of CD3-21.

55. The CD2 binding molecule of embodiment 32, wherein ABM2 comprises the CDR sequences of CD3-22.

56. The CD2 binding molecule of embodiment 32, wherein ABM2 comprises the CDR sequences of CD3-23.

57. The CD2 binding molecule of embodiment 32, wherein ABM2 comprises the CDR sequences of CD3-24.

58. The CD2 binding molecule of embodiment 32, wherein ABM2 comprises the CDR sequences of CD3-25.

59. The CD2 binding molecule of embodiment 32, wherein ABM2 comprises the CDR sequences of CD3-26.

60. The CD2 binding molecule of embodiment 32, wherein ABM2 comprises the CDR sequences of CD3-27.

61. The CD2 binding molecule of embodiment 32, wherein ABM2 comprises the CDR sequences of CD3-28.

62. The CD2 binding molecule of embodiment 32, wherein ABM2 comprises the CDR sequences of CD3-29.

63. The CD2 binding molecule of embodiment 32, wherein ABM2 comprises the CDR sequences of CD3-30.

64. The CD2 binding molecule of embodiment 32, wherein ABM2 comprises the CDR sequences of CD3-31.

65. The CD2 binding molecule of embodiment 32, wherein ABM2 comprises the CDR sequences of CD3-32.

66. The CD2 binding molecule of embodiment 32, wherein ABM2 comprises the CDR sequences of CD3-33.

67. The CD2 binding molecule of embodiment 32, wherein ABM2 comprises the CDR sequences of CD3-34.

68. The CD2 binding molecule of embodiment 32, wherein ABM2 comprises the CDR sequences of CD3-35.

69. The CD2 binding molecule of embodiment 32, wherein ABM2 comprises the CDR sequences of CD3-36.

70. The CD2 binding molecule of embodiment 32, wherein ABM2 comprises the CDR sequences of CD3-37.

71. The CD2 binding molecule of embodiment 32, wherein ABM2 comprises the CDR sequences of CD3-38.

72. The CD2 binding molecule of embodiment 32, wherein ABM2 comprises the CDR sequences of CD3-39.

73. The CD2 binding molecule of embodiment 32, wherein ABM2 comprises the CDR sequences of CD3-40.

74. The CD2 binding molecule of embodiment 32, wherein ABM2 comprises the CDR sequences of CD3-41.

75. The CD2 binding molecule of embodiment 32, wherein ABM2 comprises the CDR sequences of CD3-42.

76. The CD2 binding molecule of embodiment 32, wherein ABM2 comprises the CDR sequences of CD3-43.

77. The CD2 binding molecule of embodiment 32, wherein ABM2 comprises the CDR sequences of CD3-44.

78. The CD2 binding molecule of embodiment 32, wherein ABM2 comprises the CDR sequences of CD3-45.

79. The CD2 binding molecule of embodiment 32, wherein ABM2 comprises the CDR sequences of CD3-46.

80. The CD2 binding molecule of embodiment 32, wherein ABM2 comprises the CDR sequences of CD3-47.

81. The CD2 binding molecule of embodiment 32, wherein ABM2 comprises the CDR sequences of CD3-48.

82. The CD2 binding molecule of embodiment 32, wherein ABM2 comprises the CDR sequences of CD3-49.

83. The CD2 binding molecule of embodiment 32, wherein ABM2 comprises the CDR sequences of CD3-50.

84. The CD2 binding molecule of embodiment 32, wherein ABM2 comprises the CDR sequences of CD3-51.

85. The CD2 binding molecule of embodiment 32, wherein ABM2 comprises the CDR sequences of CD3-52.

86. The CD2 binding molecule of embodiment 32, wherein ABM2 comprises the CDR sequences of CD3-53.

87. The CD2 binding molecule of embodiment 32, wherein ABM2 comprises the CDR sequences of CD3-54.

88. The CD2 binding molecule of embodiment 32, wherein ABM2 comprises the CDR sequences of CD3-55.

89. The CD2 binding molecule of embodiment 32, wherein ABM2 comprises the CDR sequences of CD3-56.

90. The CD2 binding molecule of embodiment 32, wherein ABM2 comprises the CDR sequences of CD3-57.

91. The CD2 binding molecule of embodiment 32, wherein ABM2 comprises the CDR sequences of CD3-58.

92. The CD2 binding molecule of embodiment 32, wherein ABM2 comprises the CDR sequences of CD3-59.

93. The CD2 binding molecule of embodiment 32, wherein ABM2 comprises the CDR sequences of CD3-60.

94. The CD2 binding molecule of embodiment 32, wherein ABM2 comprises the CDR sequences of CD3-61.

95. The CD2 binding molecule of embodiment 32, wherein ABM2 comprises the CDR sequences of CD3-62.
96. The CD2 binding molecule of embodiment 32, wherein ABM2 comprises the CDR sequences of CD3-63.
97. The CD2 binding molecule of embodiment 32, wherein ABM2 comprises the CDR sequences of CD3-64.
98. The CD2 binding molecule of embodiment 32, wherein ABM2 comprises the CDR sequences of CD3-65.
99. The CD2 binding molecule of embodiment 32, wherein ABM2 comprises the CDR sequences of CD3-66.
100. The CD2 binding molecule of embodiment 32, wherein ABM2 comprises the CDR sequences of CD3-67.
101. The CD2 binding molecule of embodiment 32, wherein ABM2 comprises the CDR sequences of CD3-68.
102. The CD2 binding molecule of embodiment 32, wherein ABM2 comprises the CDR sequences of CD3-69.
103. The CD2 binding molecule of embodiment 32, wherein ABM2 comprises the CDR sequences of CD3-70.
104. The CD2 binding molecule of embodiment 32, wherein ABM2 comprises the CDR sequences of CD3-71.
105. The CD2 binding molecule of embodiment 32, wherein ABM2 comprises the CDR sequences of CD3-72.
106. The CD2 binding molecule of embodiment 32, wherein ABM2 comprises the CDR sequences of CD3-73.
107. The CD2 binding molecule of embodiment 32, wherein ABM2 comprises the CDR sequences of CD3-74.
108. The CD2 binding molecule of embodiment 32, wherein ABM2 comprises the CDR sequences of CD3-75.
109. The CD2 binding molecule of embodiment 32, wherein ABM2 comprises the CDR sequences of CD3-76.
110. The CD2 binding molecule of embodiment 32, wherein ABM2 comprises the CDR sequences of CD3-77.
111. The CD2 binding molecule of embodiment 32, wherein ABM2 comprises the CDR sequences of CD3-78.
112. The CD2 binding molecule of embodiment 32, wherein ABM2 comprises the CDR sequences of CD3-79.
113. The CD2 binding molecule of embodiment 32, wherein ABM2 comprises the CDR sequences of CD3-80.
114. The CD2 binding molecule of embodiment 32, wherein ABM2 comprises the CDR sequences of CD3-81.
115. The CD2 binding molecule of embodiment 32, wherein ABM2 comprises the CDR sequences of CD3-82.
116. The CD2 binding molecule of embodiment 32, wherein ABM2 comprises the CDR sequences of CD3-83.
117. The CD2 binding molecule of embodiment 32, wherein ABM2 comprises the CDR sequences of CD3-84.
118. The CD2 binding molecule of embodiment 32, wherein ABM2 comprises the CDR sequences of CD3-85.
119. The CD2 binding molecule of embodiment 32, wherein ABM2 comprises the CDR sequences of CD3-86.
120. The CD2 binding molecule of embodiment 32, wherein ABM2 comprises the CDR sequences of CD3-87.
121. The CD2 binding molecule of embodiment 32, wherein ABM2 comprises the CDR sequences of CD3-88.
122. The CD2 binding molecule of embodiment 32, wherein ABM2 comprises the CDR sequences of CD3-89.
123. The CD2 binding molecule of embodiment 32, wherein ABM2 comprises the CDR sequences of CD3-90.
124. The CD2 binding molecule of embodiment 32, wherein ABM2 comprises the CDR sequences of CD3-91.
125. The CD2 binding molecule of embodiment 32, wherein ABM2 comprises the CDR sequences of CD3-92.
126. The CD2 binding molecule of embodiment 32, wherein ABM2 comprises the CDR sequences of CD3-93.
127. The CD2 binding molecule of embodiment 32, wherein ABM2 comprises the CDR sequences of CD3-95.
128. The CD2 binding molecule of embodiment 32, wherein ABM2 comprises the CDR sequences of CD3-95.
129. The CD2 binding molecule of embodiment 32, wherein ABM2 comprises the CDR sequences of CD3-96.
130. The CD2 binding molecule of embodiment 32, wherein ABM2 comprises the CDR sequences of CD3-97.
131. The CD2 binding molecule of embodiment 32, wherein ABM2 comprises the CDR sequences of CD3-98.
132. The CD2 binding molecule of embodiment 32, wherein ABM2 comprises the CDR sequences of CD3-99.
133. The CD2 binding molecule of embodiment 32, wherein ABM2 comprises the CDR sequences of CD3-100.
134. The CD2 binding molecule of embodiment 32, wherein ABM2 comprises the CDR sequences of CD3-101.
135. The CD2 binding molecule of embodiment 32, wherein ABM2 comprises the CDR sequences of CD3-102.
136. The CD2 binding molecule of embodiment 32, wherein ABM2 comprises the CDR sequences of CD3-103.
137. The CD2 binding molecule of embodiment 32, wherein ABM2 comprises the CDR sequences of CD3-104.
138. The CD2 binding molecule of embodiment 32, wherein ABM2 comprises the CDR sequences of CD3-105.
139. The CD2 binding molecule of embodiment 32, wherein ABM2 comprises the CDR sequences of CD3-106.
140. The CD2 binding molecule of embodiment 32, wherein ABM2 comprises the CDR sequences of CD3-107.
141. The CD2 binding molecule of embodiment 32, wherein ABM2 comprises the CDR sequences of CD3-108.
142. The CD2 binding molecule of embodiment 32, wherein ABM2 comprises the CDR sequences of CD3-109.
143. The CD2 binding molecule of embodiment 32, wherein ABM2 comprises the CDR sequences of CD3-110.
144. The CD2 binding molecule of embodiment 32, wherein ABM2 comprises the CDR sequences of CD3-111.
145. The CD2 binding molecule of embodiment 32, wherein ABM2 comprises the CDR sequences of CD3-112.
146. The CD2 binding molecule of embodiment 32, wherein ABM2 comprises the CDR sequences of CD3-113.
147. The CD2 binding molecule of embodiment 32, wherein ABM2 comprises the CDR sequences of CD3-114.
148. The CD2 binding molecule of embodiment 32, wherein ABM2 comprises the CDR sequences of CD3-115.
149. The CD2 binding molecule of embodiment 32, wherein ABM2 comprises the CDR sequences of CD3-116.
150. The CD2 binding molecule of embodiment 32, wherein ABM2 comprises the CDR sequences of CD3-117.
151. The CD2 binding molecule of embodiment 32, wherein ABM2 comprises the CDR sequences of CD3-118.
152. The CD2 binding molecule of embodiment 32, wherein ABM2 comprises the CDR sequences of CD3-119.
153. The CD2 binding molecule of embodiment 32, wherein ABM2 comprises the CDR sequences of CD3-120.
154. The CD2 binding molecule of embodiment 32, wherein ABM2 comprises the CDR sequences of CD3-121.
155. The CD2 binding molecule of embodiment 32, wherein ABM2 comprises the CDR sequences of CD3-122.
156. The CD2 binding molecule of embodiment 32, wherein ABM2 comprises the CDR sequences of CD3-123.
157. The CD2 binding molecule of embodiment 32, wherein ABM2 comprises the CDR sequences of CD3-124.
158. The CD2 binding molecule of embodiment 32, wherein ABM2 comprises the CDR sequences of CD3-125.
159. The CD2 binding molecule of embodiment 32, wherein ABM2 comprises the CDR sequences of CD3-126.
160. The CD2 binding molecule of embodiment 32, wherein ABM2 comprises the CDR sequences of CD3-127.

161. The CD2 binding molecule of embodiment 32, wherein ABM2 comprises the CDR sequences of CD3-128.

162. The CD2 binding molecule of embodiment 32, wherein ABM2 comprises the CDR sequences of CD3-129.

163. The CD2 binding molecule of embodiment 32, wherein ABM2 comprises the CDR sequences of CD3-130.

164. The CD2 binding molecule of any one of embodiments 34 to 163, wherein the CDRs are defined by Kabat numbering, as set forth in Table 12B.

165. The CD2 binding molecule of any one of embodiments 34 to 163, wherein the CDRs are defined by Chothia numbering, as set forth in Table 12C.

166. The CD2 binding molecule of any one of embodiment embodiments 34 to 163, wherein the CDRs are defined by a combination of Kabat and Chothia numbering, as set forth in Table 12D.

167. The CD2 binding molecule of embodiment 32, wherein ABM2 comprises the heavy and light chain variable sequences of CD3-1, as set forth in Table 12A.

168. The CD2 binding molecule of embodiment 32, wherein ABM2 comprises the heavy and light chain variable sequences of CD3-2, as set forth in Table 12A.

169. The CD2 binding molecule of embodiment 32, wherein ABM2 comprises the heavy and light chain variable sequences of CD3-3, as set forth in Table 12A.

170. The CD2 binding molecule of embodiment 32, wherein ABM2 comprises the heavy and light chain variable sequences of CD3-4, as set forth in Table 12A.

171. The CD2 binding molecule of embodiment 32, wherein ABM2 comprises the heavy and light chain variable sequences of CD3-5, as set forth in Table 12A.

172. The CD2 binding molecule of embodiment 32, wherein ABM2 comprises the heavy and light chain variable sequences of CD3-6, as set forth in Table 12A.

173. The CD2 binding molecule of embodiment 32, wherein ABM2 comprises the heavy and light chain variable sequences of CD3-7, as set forth in Table 12A.

174. The CD2 binding molecule of embodiment 32, wherein ABM2 comprises the heavy and light chain variable sequences of CD3-8, as set forth in Table 12A.

175. The CD2 binding molecule of embodiment 32, wherein ABM2 comprises the heavy and light chain variable sequences of CD3-9, as set forth in Table 12A.

176. The CD2 binding molecule of embodiment 32, wherein ABM2 comprises the heavy and light chain variable sequences of CD3-10, as set forth in Table 12A.

177. The CD2 binding molecule of embodiment 32, wherein ABM2 comprises the heavy and light chain variable sequences of CD3-11, as set forth in Table 12A.

178. The CD2 binding molecule of embodiment 32, wherein ABM2 comprises the heavy and light chain variable sequences of CD3-12, as set forth in Table 12A.

179. The CD2 binding molecule of embodiment 32, wherein ABM2 comprises the heavy and light chain variable sequences of CD3-13, as set forth in Table 12A.

180. The CD2 binding molecule of embodiment 32, wherein ABM2 comprises the heavy and light chain variable sequences of CD3-14, as set forth in Table 12A.

181. The CD2 binding molecule of embodiment 32, wherein ABM2 comprises the heavy and light chain variable sequences of CD3-15, as set forth in Table 12A.

182. The CD2 binding molecule of embodiment 32, wherein ABM2 comprises the heavy and light chain variable sequences of CD3-16, as set forth in Table 12A.

183. The CD2 binding molecule of embodiment 32, wherein ABM2 comprises the heavy and light chain variable sequences of CD3-17, as set forth in Table 12A.

184. The CD2 binding molecule of embodiment 32, wherein ABM2 comprises the heavy and light chain variable sequences of CD3-18, as set forth in Table 12A.

185. The CD2 binding molecule of embodiment 32, wherein ABM2 comprises the heavy and light chain variable sequences of CD3-19, as set forth in Table 12A.

186. The CD2 binding molecule of embodiment 32, wherein ABM2 comprises the heavy and light chain variable sequences of CD3-20, as set forth in Table 12A.

187. The CD2 binding molecule of embodiment 32, wherein ABM2 comprises the heavy and light chain variable sequences of CD3-21, as set forth in Table 12A.

188. The CD2 binding molecule of embodiment 32, wherein ABM2 comprises the heavy and light chain variable sequences of CD3-22, as set forth in Table 12A.

189. The CD2 binding molecule of embodiment 32, wherein ABM2 comprises the heavy and light chain variable sequences of CD3-23, as set forth in Table 12A.

190. The CD2 binding molecule of embodiment 32, wherein ABM2 comprises the heavy and light chain variable sequences of CD3-24, as set forth in Table 12A.

191. The CD2 binding molecule of embodiment 32, wherein ABM2 comprises the heavy and light chain variable sequences of CD3-25, as set forth in Table 12A.

192. The CD2 binding molecule of embodiment 32, wherein ABM2 comprises the heavy and light chain variable sequences of CD3-26, as set forth in Table 12A.

193. The CD2 binding molecule of embodiment 32, wherein ABM2 comprises the heavy and light chain variable sequences of CD3-27, as set forth in Table 12A.

194. The CD2 binding molecule of embodiment 32, wherein ABM2 comprises the heavy and light chain variable sequences of CD3-28, as set forth in Table 12A.

195. The CD2 binding molecule of embodiment 32, wherein ABM2 comprises the heavy and light chain variable sequences of CD3-129, as set forth in Table 12A.

196. The CD2 binding molecule of embodiment 32, wherein ABM2 comprises the heavy and light chain variable sequences of CD3-130, as set forth in Table 12A.

197. The CD2 binding molecule of embodiment 32, wherein ABM2 comprises the amino acid sequence of the scFV designated as CD3-12 in Table 12A.

198. The CD2 binding molecule of embodiment 32, wherein ABM2 comprises the amino acid sequence of the scFV designated as CD3-21 in Table 12A.

199. The CD2 binding molecule of embodiment 32, wherein ABM2 comprises the amino acid sequence of the scFV designated as CD3-22 in Table 12A.

200. The CD2 binding molecule of embodiment 32, wherein ABM2 comprises the amino acid sequence of the scFV designated as CD3-23 in Table 12A.

201. The CD2 binding molecule of embodiment 32, wherein ABM2 comprises the amino acid sequence of the scFV designated as CD3-24 in Table 12A.

202. The CD2 binding molecule of embodiment 32, wherein ABM2 comprises the amino acid sequence of the scFV designated as CD3-25 in Table 12A.

203. The CD2 binding molecule of embodiment 32, wherein ABM2 comprises the amino acid sequence of the scFV designated as CD3-26 in Table 12A.

204. The CD2 binding molecule of embodiment 32, wherein ABM2 comprises the amino acid sequence of the scFV designated as CD3-27 in Table 12A.

205. The CD2 binding molecule of embodiment 32, wherein ABM2 comprises the amino acid sequence of the scFV designated as CD3-28 in Table 12A.

206. The CD2 binding molecule of embodiment 32, ABM2 comprises the amino acid sequence of the scFV designated as CD3-129 in Table 12A.

207. The CD2 binding molecule of embodiment 32, wherein ABM2 comprises the amino acid sequence of the scFV designated as CD3-130 in Table 12A.

208. The CD2 binding molecule of embodiment 32, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AA, Table AB, or Table AC.

209. The CD2 binding molecule of embodiment 208, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AA.

210. The CD2 binding molecule of embodiment 209, wherein the amino acid designated $X_1$ in Table AA is T.

211. The CD2 binding molecule of embodiment 209, wherein the amino acid designated $X_1$ in Table AA is A.

212. The CD2 binding molecule of any one of embodiments 209 to 211, wherein the amino acid designated $X_2$ in Table AA is S.

213. The CD2 binding molecule of any one of embodiments 209 to 211, wherein the amino acid designated $X_2$ in Table AA is R.

214. The CD2 binding molecule of any one of embodiments 209 to 213, wherein the amino acid designated $X_3$ in Table AA is N.

215. The CD2 binding molecule of any one of embodiments 209 to 213, wherein the amino acid designated $X_3$ in Table AA is Y.

216. The CD2 binding molecule of any one of embodiments 209 to 213, wherein the amino acid designated $X_3$ in Table AA is Q.

217. The CD2 binding molecule of any one of embodiments 209 to 216, wherein the amino acid designated $X_4$ in Table AA is H.

218. The CD2 binding molecule of any one of embodiments 209 to 216, wherein the amino acid designated $X_4$ in Table AA is S.

219. The CD2 binding molecule of any one of embodiments 209 to 218, wherein the amino acid designated $X_5$ in Table AA is M.

220. The CD2 binding molecule of any one of embodiments 209 to 218, wherein the amino acid designated $X_5$ in Table AA is L.

221. The CD2 binding molecule of any one of embodiments 209 to 220, wherein the amino acid designated $X_6$ in Table AA is K.

222. The CD2 binding molecule of any one of embodiments 209 to 220, wherein the amino acid designated $X_6$ in Table AA is R.

223. The CD2 binding molecule of any one of embodiments 209 to 222, wherein the amino acid designated $X_7$ in Table AA is S.

224. The CD2 binding molecule of any one of embodiments 209 to 222, wherein the amino acid designated $X_7$ in Table AA is K.

225. The CD2 binding molecule of any one of embodiments 209 to 224, wherein the amino acid designated $X_{55}$ in Table AA is F.

226. The CD2 binding molecule of any one of embodiments 209 to 224, wherein the amino acid designated $X_{55}$ in Table AA is Y.

227. The CD2 binding molecule of any one of embodiments 209 to 224, wherein the amino acid designated $X_{55}$ in Table AA is S.

228. The CD2 binding molecule of any one of embodiments 209 to 227, wherein the amino acid designated $X_8$ in Table AA is W.

229. The CD2 binding molecule of any one of embodiments 209 to 227, wherein the amino acid designated $X_8$ in Table AA is Y.

230. The CD2 binding molecule of any one of embodiments 209 to 227, wherein the amino acid designated $X_8$ in Table AA is S.

231. The CD2 binding molecule of any one of embodiments 209 to 227, wherein the amino acid designated $X_8$ in Table AA is T.

232. The CD2 binding molecule of any one of embodiments 209 to 231, wherein the amino acid designated $X_9$ in Table AA is W.

233. The CD2 binding molecule of any one of embodiments 209 to 231, wherein the amino acid designated $X_9$ in Table AA is Y.

234. The CD2 binding molecule of any one of embodiments 209 to 231, wherein the amino acid designated $X_9$ in Table AA is S.

235. The CD2 binding molecule of any one of embodiments 209 to 231, wherein the amino acid designated $X_9$ in Table AA is T.

236. The CD2 binding molecule of any one of embodiments 209 to 235, wherein the amino acid designated $X_{10}$ in Table AA is H.

237. The CD2 binding molecule of any one of embodiments 209 to 235, wherein the amino acid designated $X_{10}$ in Table AA is Y.

238. The CD2 binding molecule of any one of embodiments 209 to 237, wherein the amino acid designated $X_{11}$ in Table AA is S.

239. The CD2 binding molecule of any one of embodiments 209 to 237, wherein the amino acid designated $X_{11}$ in Table AA is G.

240. The CD2 binding molecule of any one of embodiments 209 to 239, wherein the amino acid designated $X_{12}$ in Table AA is I.

241. The CD2 binding molecule of any one of embodiments 209 to 239, wherein the amino acid designated $X_{12}$ in Table AA is L.

242. The CD2 binding molecule of any one of embodiments 209 to 241, wherein the amino acid designated $X_{13}$ in Table AA is V.

243. The CD2 binding molecule of any one of embodiments 209 to 241, wherein the amino acid designated $X_{13}$ in Table AA is G.

244. The CD2 binding molecule of any one of embodiments 209 to 243, wherein the amino acid designated $X_{14}$ in Table AA is R.

245. The CD2 binding molecule of any one of embodiments 209 to 243, wherein the amino acid designated $X_{14}$ in Table AA is N.

246. The CD2 binding molecule of any one of embodiments 209 to 245, wherein the amino acid designated $X_{15}$ in Table AA is D.

247. The CD2 binding molecule of any one of embodiments 209 to 245, wherein the amino acid designated $X_{15}$ in Table AA is E.

248. The CD2 binding molecule of any one of embodiments 209 to 245, wherein the amino acid designated $X_{15}$ in Table AA is L.

249. The CD2 binding molecule of any one of embodiments 209 to 248, wherein the amino acid designated $X_{16}$ in Table AA is G.

250. The CD2 binding molecule of any one of embodiments 209 to 248, wherein the amino acid designated $X_{16}$ in Table AA is N.

251. The CD2 binding molecule of any one of embodiments 209 to 248, wherein the amino acid designated $X_{16}$ in Table AA is E.

252. The CD2 binding molecule of any one of embodiments 209 to 251, wherein the amino acid designated $X_{17}$ in Table AA is R.

253. The CD2 binding molecule of any one of embodiments 209 to 251, wherein the amino acid designated $X_{17}$ in Table AA is S.

254. The CD2 binding molecule of any one of embodiments 209 to 253, wherein the amino acid designated $X_{18}$ in Table AA is V.

255. The CD2 binding molecule of any one of embodiments 209 to 253, wherein the amino acid designated $X_{18}$ in Table AA is T.

256. The CD2 binding molecule of any one of embodiments 209 to 255, wherein the amino acid designated $X_{19}$ in Table AA is N.

257. The CD2 binding molecule of any one of embodiments 209 to 255, wherein the amino acid designated $X_{19}$ in Table AA is T.

258. The CD2 binding molecule of any one of embodiments 209 to 257, wherein the amino acid designated $X_{20}$ in Table AA is R.

259. The CD2 binding molecule of any one of embodiments 209 to 257, wherein the amino acid designated $X_{20}$ in Table AA is L.

260. The CD2 binding molecule of any one of embodiments 209 to 259, wherein the amino acid designated $X_{21}$ in Table AA is F.

261. The CD2 binding molecule of any one of embodiments 209 to 259, wherein the amino acid designated $X_{21}$ in Table AA is E.

262. The CD2 binding molecule of any one of embodiments 209 to 261, wherein the amino acid designated $X_{22}$ in Table AA is S.

263. The CD2 binding molecule of any one of embodiments 209 to 261, wherein the amino acid designated $X_{22}$ in Table AA is Y.

264. The CD2 binding molecule of any one of embodiments 209 to 263, wherein the amino acid designated $X_{23}$ in Table AA is S.

265. The CD2 binding molecule of any one of embodiments 209 to 263, wherein the amino acid designated $X_{23}$ in Table AA is Y.

266. The CD2 binding molecule of any one of embodiments 209 to 265, wherein the amino acid designated $X_{24}$ in Table AA is S.

267. The CD2 binding molecule of any one of embodiments 209 to 265, wherein the amino acid designated $X_{24}$ in Table AA is A.

268. The CD2 binding molecule of any one of embodiments 209 to 267, wherein the amino acid designated $X_{25}$ in Table AA is H.

269. The CD2 binding molecule of any one of embodiments 209 to 267, wherein the amino acid designated $X_{25}$ in Table AA is T.

270. The CD2 binding molecule of any one of embodiments 209 to 269, wherein the amino acid designated $X_{26}$ in Table AA is F.

271. The CD2 binding molecule of any one of embodiments 209 to 269, wherein the amino acid designated $X_{26}$ in Table AA is Y.

272. The CD2 binding molecule of any one of embodiments 209 to 271, wherein the amino acid designated $X_{27}$ in Table AA is W.

273. The CD2 binding molecule of any one of embodiments 209 to 271, wherein the amino acid designated $X_{27}$ in Table AA is Y.

274. The CD2 binding molecule of any one of embodiments 209 to 273, wherein ABM2 comprises the CDR-H1 sequence C1-1.

275. The CD2 binding molecule of any one of embodiments 209 to 273, wherein ABM2 comprises the CDR-H1 sequence C1-2.

276. The CD2 binding molecule of any one of embodiments 209 to 273, wherein ABM2 comprises the CDR-H1 sequence C1-3.

277. The CD2 binding molecule of any one of embodiments 209 to 273, wherein ABM2 comprises the CDR-H1 sequence C1-4.

278. The CD2 binding molecule of any one of embodiments 209 to 277, wherein ABM2 comprises the CDR-H2 sequence C1-5.

279. The CD2 binding molecule of any one of embodiments 209 to 277, wherein ABM2 comprises the CDR-H2 sequence C1-6.

280. The CD2 binding molecule of any one of embodiments 209 to 277, wherein ABM2 comprises the CDR-H2 sequence C1-7.

281. The CD2 binding molecule of any one of embodiments 209 to 280, wherein ABM2 comprises the CDR-H3 sequence C1-8.

282. The CD2 binding molecule of any one of embodiments 209 to 280, wherein ABM2 comprises the CDR-H3 sequence C1-9.

283. The CD2 binding molecule of any one of embodiments 209 to 280, wherein ABM2 comprises the CDR-H3 sequence C1-10.

284. The CD2 binding molecule of any one of embodiments 209 to 280, wherein ABM2 comprises the CDR-H3 sequence C1-11.

285. The CD2 binding molecule of any one of embodiments 209 to 284, wherein ABM2 comprises the CDR-L1 sequence C1-12.

286. The CD2 binding molecule of any one of embodiments 209 to 284, wherein ABM2 comprises the CDR-L1 sequence C1-13.

287. The CD2 binding molecule of any one of embodiments 209 to 284, wherein ABM2 comprises the CDR-L1 sequence C1-14.

288. The CD2 binding molecule of any one of embodiments 209 to 284, wherein ABM2 comprises the CDR-L1 sequence C1-15.

289. The CD2 binding molecule of any one of embodiments 209 to 284, wherein ABM2 comprises the CDR-L1 sequence C1-16.

290. The CD2 binding molecule of any one of embodiments 209 to 284, wherein ABM2 comprises the CDR-L1 sequence C1-17.

291. The CD2 binding molecule of any one of embodiments 209 to 290, wherein ABM2 comprises the CDR-L2 sequence C1-18.

292. The CD2 binding molecule of any one of embodiments 209 to 290, wherein ABM2 comprises the CDR-L2 sequence C1-19.

293. The CD2 binding molecule of any one of embodiments 209 to 292, wherein ABM2 comprises the CDR-L3 sequence C1-20.

294. The CD2 binding molecule of any one of embodiments 209 to 292, wherein ABM2 comprises the CDR-L3 sequence C1-21.

295. The CD2 binding molecule of any one of embodiments 209 to 292, wherein ABM2 comprises the CDR-L3 sequence C1-22.

296. The CD2 binding molecule of any one of embodiments 209 to 292, wherein ABM2 comprises the CDR-L3 sequence C1-23.

297. The CD2 binding molecule of embodiment 208, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AB.

298. The CD2 binding molecule of embodiment 297, wherein the amino acid designated $X_{28}$ in Table AB is V.

299. The CD2 binding molecule of embodiment 297, wherein the amino acid designated $X_{28}$ in Table AB is I.

300. The CD2 binding molecule of any one of embodiments 297 to 299, wherein the amino acid designated $X_{29}$ in Table AB is F.

301. The CD2 binding molecule of any one of embodiments 297 to 299, wherein the amino acid designated $X_{29}$ in Table AB is Y.

302. The CD2 binding molecule of any one of embodiments 297 to 301, wherein the amino acid designated $X_{30}$ in Table AB is N.

303. The CD2 binding molecule of any one of embodiments 297 to 301, wherein the amino acid designated $X_{30}$ in Table AB is S.

304. The CD2 binding molecule of any one of embodiments 297 to 303, wherein the amino acid designated $X_{31}$ in Table AB is A.

305. The CD2 binding molecule of any one of embodiments 297 to 303, wherein the amino acid designated $X_{31}$ in Table AB is S.

306. The CD2 binding molecule of any one of embodiments 297 to 305, wherein the amino acid designated $X_{32}$ in Table AB is T.

307. The CD2 binding molecule of any one of embodiments 297 to 305, wherein the amino acid designated $X_{32}$ in Table AB is K.

308. The CD2 binding molecule of any one of embodiments 297 to 307, wherein the amino acid designated $X_{33}$ in Table AB is T.

309. The CD2 binding molecule of any one of embodiments 297 to 307, wherein the amino acid designated $X_{33}$ in Table AB is A.

310. The CD2 binding molecule of any one of embodiments 297 to 309, wherein the amino acid designated $X_{34}$ in Table AB is S.

311. The CD2 binding molecule of any one of embodiments 297 to 309, wherein the amino acid designated $X_{34}$ in Table AB is R.

312. The CD2 binding molecule of any one of embodiments 297 to 311, wherein the amino acid designated $X_{35}$ in Table AB is N.

313. The CD2 binding molecule of any one of embodiments 297 to 311, wherein the amino acid designated $X_{35}$ in Table AB is G.

314. The CD2 binding molecule of any one of embodiments 297 to 313, wherein the amino acid designated $X_{36}$ in Table AB is S.

315. The CD2 binding molecule of any one of embodiments 297 to 313, wherein the amino acid designated $X_{36}$ in Table AB is A.

316. The CD2 binding molecule of any one of embodiments 297 to 315, wherein the amino acid designated $X_{37}$ in Table AB is A.

317. The CD2 binding molecule of any one of embodiments 297 to 315, wherein the amino acid designated $X_{37}$ in Table AB is T.

318. The CD2 binding molecule of any one of embodiments 297 to 315, wherein the amino acid designated $X_{37}$ in Table AB is S.

319. The CD2 binding molecule of any one of embodiments 297 to 318, wherein the amino acid designated $X_{38}$ in Table AB is N.

320. The CD2 binding molecule of any one of embodiments 297 to 318, wherein the amino acid designated $X_{38}$ in Table AB is D.

321. The CD2 binding molecule of any one of embodiments 297 to 320, wherein the amino acid designated $X_{39}$ in Table AB is N.

322. The CD2 binding molecule of any one of embodiments 297 to 320, wherein the amino acid designated $X_{39}$ in Table AB is K.

323. The CD2 binding molecule of any one of embodiments 297 to 322, wherein the amino acid designated $X_{40}$ in Table AB is D.

324. The CD2 binding molecule of any one of embodiments 297 to 322, wherein the amino acid designated $X_{40}$ in Table AB is N.

325. The CD2 binding molecule of any one of embodiments 297 to 324, wherein the amino acid designated $X_{41}$ in Table AB is H.

326. The CD2 binding molecule of any one of embodiments 297 to 324, wherein the amino acid designated $X_{41}$ in Table AB is N.

327. The CD2 binding molecule of any one of embodiments 297 to 326, wherein the amino acid designated $X_{42}$ in Table AB is Q.

328. The CD2 binding molecule of any one of embodiments 297 to 326, wherein the amino acid designated $X_{42}$ in Table AB is E.

329. The CD2 binding molecule of any one of embodiments 297 to 328, wherein the amino acid designated $X_{43}$ in Table AB is R.

330. The CD2 binding molecule of any one of embodiments 297 to 328, wherein the amino acid designated $X_{43}$ in Table AB is S.

331. The CD2 binding molecule of any one of embodiments 297 to 328, wherein the amino acid designated $X_{43}$ in Table AB is G.

332. The CD2 binding molecule of any one of embodiments 297 to 331, wherein ABM2 comprises the CDR-H1 sequence C2-1.

333. The CD2 binding molecule of any one of embodiments 297 to 331, wherein ABM2 comprises the CDR-H1 sequence C2-2.

334. The CD2 binding molecule of any one of embodiments 297 to 331, wherein ABM2 comprises the CDR-H1 sequence C2-3.

335. The CD2 binding molecule of any one of embodiments 297 to 331, wherein ABM2 comprises the CDR-H1 sequence C2-4.

336. The CD2 binding molecule of any one of embodiments 297 to 335, wherein ABM2 comprises the CDR-H2 sequence C2-5.

337. The CD2 binding molecule of any one of embodiments 297 to 335, wherein ABM2 comprises the CDR-H2 sequence C2-6.

338. The CD2 binding molecule of any one of embodiments 297 to 335, wherein ABM2 comprises the CDR-H2 sequence C2-7.

339. The CD2 binding molecule of any one of embodiments 297 to 338, wherein ABM2 comprises the CDR-H3 sequence C2-8.

340. The CD2 binding molecule of any one of embodiments 297 to 338, wherein ABM2 comprises the CDR-H3 sequence C2-9.

341. The CD2 binding molecule of any one of embodiments 297 to 340, wherein ABM2 comprises the CDR-L1 sequence C2-10.

342. The CD2 binding molecule of any one of embodiments 297 to 340, wherein ABM2 comprises the CDR-L1 sequence C2-11.

343. The CD2 binding molecule of any one of embodiments 297 to 340, wherein ABM2 comprises the CDR-L1 sequence C2-12.

344. The CD2 binding molecule of any one of embodiments 297 to 343, wherein ABM2 comprises the CDR-L2 sequence C2-13.

345. The CD2 binding molecule of any one of embodiments 297 to 343, wherein ABM2 comprises the CDR-L2 sequence C2-14.

346. The CD2 binding molecule of any one of embodiments 297 to 343, wherein ABM2 comprises the CDR-L2 sequence C2-15.

347. The CD2 binding molecule of any one of embodiments 297 to 346, wherein ABM2 comprises the CDR-L3 sequence C2-16.

348. The CD2 binding molecule of any one of embodiments 297 to 346, wherein ABM2 comprises the CDR-L3 sequence C2-17.

349. The CD2 binding molecule of embodiment 208, wherein ABM2 comprises a CDR-H1 sequence, a CDR-H2 sequence, a CDR-H3 sequence, a CDR-L1 sequence, a CDR-L2 sequence, and a CDR-L3 sequence set forth in Table AC.

350. The CD2 binding molecule of embodiment 349, wherein the amino acid designated $X_{44}$ in Table AC is G.

351. The CD2 binding molecule of embodiment 349, wherein the amino acid designated $X_{44}$ in Table AC is A.

352. The CD2 binding molecule of any one of embodiments 349 to 351, wherein the amino acid designated $X_{45}$ in Table AC is H.

353. The CD2 binding molecule of any one of embodiments 349 to 351, wherein the amino acid designated $X_{45}$ in Table AC is N.

354. The CD2 binding molecule of any one of embodiments 349 to 353, wherein the amino acid designated $X_{46}$ in Table AC is D.

355. The CD2 binding molecule of any one of embodiments 349 to 353, wherein the amino acid designated $X_{46}$ in Table AC is G.

356. The CD2 binding molecule of any one of embodiments 349 to 355, wherein the amino acid designated $X_{47}$ in Table AC is A.

357. The CD2 binding molecule of any one of embodiments 349 to 355, wherein the amino acid designated $X_{47}$ in Table AC is G.

358. The CD2 binding molecule of any one of embodiments 349 to 357, wherein the amino acid designated $X_{48}$ in Table AC is N.

359. The CD2 binding molecule of any one of embodiments 349 to 357, wherein the amino acid designated $X_{48}$ in Table AC is K.

360. The CD2 binding molecule of any one of embodiments 349 to 359, wherein the amino acid designated $X_{49}$ in Table AC is V.

361. The CD2 binding molecule of any one of embodiments 349 to 359, wherein the amino acid designated $X_{49}$ in Table AC is A.

362. The CD2 binding molecule of any one of embodiments 349 to 361, wherein the amino acid designated $X_{50}$ in Table AC is N.

363. The CD2 binding molecule of any one of embodiments 349 to 361, wherein the amino acid designated $X_{50}$ in Table AC is V.

364. The CD2 binding molecule of any one of embodiments 349 to 363, wherein the amino acid designated $X_{51}$ in Table AC is A.

365. The CD2 binding molecule of any one of embodiments 349 to 363, wherein the amino acid designated $X_{51}$ in Table AC is V.

366. The CD2 binding molecule of any one of embodiments 349 to 365, wherein the amino acid designated $X_{52}$ in Table AC is Y.

367. The CD2 binding molecule of any one of embodiments 349 to 365, wherein the amino acid designated $X_{52}$ in Table AC is F.

368. The CD2 binding molecule of any one of embodiments 349 to 367, wherein the amino acid designated $X_{53}$ in Table AC is I.

369. The CD2 binding molecule of any one of embodiments 349 to 367, wherein the amino acid designated $X_{53}$ in Table AC is V.

370. The CD2 binding molecule of any one of embodiments 349 to 369, wherein the amino acid designated $X_{54}$ in Table AC is I.

371. The CD2 binding molecule of any one of embodiments 349 to 369, wherein the amino acid designated $X_{54}$ in Table AC is H.

372. The CD2 binding molecule of any one of embodiments 349 to 371, wherein ABM2 comprises the CDR-H1 sequence C3-1.

373. The CD2 binding molecule of any one of embodiments 349 to 371, wherein ABM2 comprises the CDR-H1 sequence C3-2.

374. The CD2 binding molecule of any one of embodiments 349 to 371, wherein ABM2 comprises the CDR-H1 sequence C3-3.

375. The CD2 binding molecule of any one of embodiments 349 to 371, wherein ABM2 comprises the CDR-H1 sequence C3-4.

376. The CD2 binding molecule of any one of embodiments 349 to 375, wherein ABM2 comprises the CDR-H2 sequence C3-5.

377. The CD2 binding molecule of any one of embodiments 349 to 375, wherein ABM2 comprises the CDR-H2 sequence C3-6.

378. The CD2 binding molecule of any one of embodiments 349 to 375, wherein ABM2 comprises the CDR-H2 sequence C3-7.

379. The CD2 binding molecule of any one of embodiments 349 to 378, wherein ABM2 comprises the CDR-H3 sequence C3-8.

380. The CD2 binding molecule of any one of embodiments 349 to 378, wherein ABM2 comprises the CDR-H3 sequence C3-9.

381. The CD2 binding molecule of any one of embodiments 349 to 380, wherein ABM2 comprises the CDR-L1 sequence C3-10.

382. The CD2 binding molecule of any one of embodiments 349 to 380, wherein ABM2 comprises the CDR-L1 sequence C3-11.

383. The CD2 binding molecule of any one of embodiments 349 to 380, wherein ABM2 comprises the CDR-L1 sequence C3-12.

384. The CD2 binding molecule of any one of embodiments 349 to 383, wherein ABM2 comprises the CDR-L2 sequence C3-13.

385. The CD2 binding molecule of any one of embodiments 349 to 383, wherein ABM2 comprises the CDR-L2 sequence C3-14.

386. The CD2 binding molecule of any one of embodiments 349 to 385, wherein ABM2 comprises the CDR-L3 sequence C3-15.

387. The CD2 binding molecule of any one of embodiments 349 to 385, wherein ABM2 comprises the CDR-L3 sequence C3-16.

388. The CD2 binding molecule of embodiment 32, wherein ABM2 comprises CDR-H1 CDR-H2, and CDR-H3 sequences set forth in Table AD-1, Table AE-1, Table AF-1, Table AG-1, Table AH-1, or Table AI-1, and the corresponding CDR-L1, CDR-L2, and CDR-L3 sequences set forth in Table AD-2, Table AE-2, Table AF-2, Table AG-2, Table AH-2, or Table AI-2, respectfully.

389. The CD2 binding molecule of embodiment 388, wherein ABM2 comprises CDR-H1, CDR-H2, and CDR-H3 sequences set forth in Table AD-1 and the corresponding CDR-L1, CDR-L2, and CDR-L3 sequences set forth in Table AD-2.

390. The CD2 binding molecule of embodiment 388, wherein ABM2 comprises CDR-H1, CDR-H2, and CDR-H3 sequences set forth in Table AE-1 and the corresponding CDR-L1, CDR-L2, and CDR-L3 sequences set forth in Table AE-2.

391. The CD2 binding molecule of embodiment 388, wherein ABM2 comprises CDR-H1, CDR-H2, and CDR-H3 sequences set forth in Table AF-1 and the corresponding CDR-L1, CDR-L2, and CDR-L3 sequences set forth in Table AF-2.

392. The CD2 binding molecule of embodiment 388, wherein ABM2 comprises CDR-H1, CDR-H2, and CDR-H3 sequences set forth in Table AG-1 and the corresponding CDR-L1, CDR-L2, and CDR-L3 sequences set forth in Table AG-2.

393. The CD2 binding molecule of embodiment 388, wherein ABM2 comprises CDR-H1, CDR-H2, and CDR-H3 sequences set forth in Table AH-1 and the corresponding CDR-L1, CDR-L2, and CDR-L3 sequences set forth in Table AH-2.

394. The CD2 binding molecule of embodiment 388, wherein ABM2 comprises CDR-H1, CDR-H2, and CDR-H3 sequences set forth in Table AI-1 and the corresponding CDR-L1, CDR-L2, and CDR-L3 sequences set forth in Table AI-2.

395. The CD2 binding molecule of any one of embodiments 389 to 394, wherein ABM2 comprises CDR-H1, CDR-H2, CDR-H3, CDR-L1, CDR-L2, and CDR-L3 sequences of NOV292.

396. The CD2 binding molecule of any one of embodiments 389 to 394, wherein ABM2 comprises CDR-H1, CDR-H2, CDR-H3, CDR-L1, CDR-L2, and CDR-L3 sequences of NOV123.

397. The CD2 binding molecule of any one of embodiments 389 to 394, wherein ABM2 comprises CDR-H1, CDR-H2, CDR-H3, CDR-L1, CDR-L2, and CDR-L3 sequences of Sp10b.

398. The CD2 binding molecule of any one of embodiments 389 to 394, wherein ABM2 comprises CDR-H1, CDR-H2, CDR-H3, CDR-L1, CDR-L2, and CDR-L3 sequences of NOV453.

399. The CD2 binding molecule of any one of embodiments 389 to 394, wherein ABM2 comprises CDR-H1, CDR-H2, CDR-H3, CDR-L1, CDR-L2, and CDR-L3 sequences of NOV229.

400. The CD2 binding molecule of any one of embodiments 389 to 394, wherein ABM2 comprises CDR-H1, CDR-H2, CDR-H3, CDR-L1, CDR-L2, and CDR-L3 sequences of NOV110.

401. The CD2 binding molecule of any one of embodiments 389 to 394, wherein ABM2 comprises CDR-H1, CDR-H2, CDR-H3, CDR-L1, CDR-L2, and CDR-L3 sequences of NOV832.

402. The CD2 binding molecule of any one of embodiments 389 to 394, wherein ABM2 comprises CDR-H1, CDR-H2, CDR-H3, CDR-L1, CDR-L2, and CDR-L3 sequences of NOV589.

403. The CD2 binding molecule of any one of embodiments 389 to 394, wherein ABM2 comprises CDR-H1, CDR-H2, CDR-H3, CDR-L1, CDR-L2, and CDR-L3 sequences of NOV580.

404. The CD2 binding molecule of any one of embodiments 389 to 394, wherein ABM2 comprises CDR-H1, CDR-H2, CDR-H3, CDR-L1, CDR-L2, and CDR-L3 sequences of NOV567.

405. The CD2 binding molecule of any one of embodiments 389 to 394, wherein ABM2 comprises CDR-H1, CDR-H2, CDR-H3, CDR-L1, CDR-L2, and CDR-L3 sequences of NOV221.

406. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_bkm1.

407. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11a_bkm2.

408. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_hz0.

409. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_HZ1.

410. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_sansPTM_hz1.

411. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_sansPTM_rat.

412. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY.

413. The CD2 binding molecule of any one of embodiments 389 to 394, wherein ABM2 comprises CDR-H1, 414. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VHVL_WS.

415. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SW.

416. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VHVL_TT.

417. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VHVL_TW.

418. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VHVL_WT.

419. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A VH3_VLK3.

420. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2.

421. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1.

422. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2.

423. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp9aFW1_VL_VH_S56G.

424. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP9AFW4_VL_VH_S56G.

425. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp9aFW1_VL_VH.

426. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp9aFW4_VLVH.

427. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp9arabtor_VHVL.

428. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp9arabtor_VLVH.

429. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY_SANSPTM.

430. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY_SANSPTM_Y.

431. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY_SANSPTM_S.

432. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY_Y.

433. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_YY_s.

434. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_SANSPTM.

435. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_SANSPTM_Y.

436. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_SANSPTM_S.

437. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_Y.

438. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_S.

439. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SS_SANSPTM.

440. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_WS_SANSPTM_Y.

441. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_WS_SANSPTM_S.

442. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_WS_Y.

443. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_WS_S.

444. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_WS_SANSPTM.

445. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SW_SANSPTM_Y.

446. The CD2 binding molecule of any one of embodiments 389 to 394, wherein ABM2 comprises CDR-H1, 447. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SW_Y.

448. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SW_S.

449. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_SW_SANSPTM.

450. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TW_SANSPTM_Y.

451. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TW_SANSPTM_S.

452. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TW_Y.

453. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TW_S.

454. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TW_SANSPTM.

455. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TT_SANSPTM_Y.

456. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TT_SANSPTM_S.

457. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TT_Y.

458. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TT_S.

459. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VHVL_TT_SANSPTM.

460. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_Y.

461. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_S.

462. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_Y_PTM.

463. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_S_PTM.

464. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_Y_SW.

465. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_S_SW.

466. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_Y_PTM_SW.

467. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_S_SWPTM.

468. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_SWPTM.

469. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11AVH3_VLK_3_SW.

470. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_Y.

471. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_S.

472. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_Y_PTM.

473. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_S_PTM.

474. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_Y_SW.

475. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_S_SW.

476. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_Y_PTM.

477. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_S_PTM_SW.

478. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_SW.

479. The CD2 binding molecule of any one of embodiments 389 to 394, wherein ABM2 comprises CDR-H1, 479. The CD2 binding molecule of any one of embodiments 389 to 394, wherein ABM2 comprises CDR-H1, CDR-H2, CDR-H3, CDR-L1, CDR-L2, and CDR-L3 sequences of CD3_sp11a_VH1_VK2_SW PTM.

480. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_Y.

481. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_S.

482. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_Y_PTM.

483. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_S_PTM.

484. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_Y_SW.

485. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_S_SW.

486. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_Y_PTM.

487. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_S_PTM_SW.

488. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1PTM_SW.

489. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH3_VLK1_SW.

490. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_Y.

491. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_S.

492. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_Y_PTM.

493. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_S_PTM.

494. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_Y_SW.

495. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_S_SW.

496. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_Y_PTM_SW.

497. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_S_PTM_SW.

498. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_PTM_SW.

499. The CD2 binding molecule of any one of embodiments 389 to 394, wherein ABM2 comprises CDR-H1, CDR-H2, CDR-H3, CDR-L1, CDR-L2, and CDR-L3 sequences of CD3_SP11A_VH5_VK2_SW.

500. The CD2 binding molecule of embodiment 388, wherein ABM2 comprises a heavy chain variable sequence set forth in Table AJ-1 and the corresponding light chain variable sequence set forth in Table AJ-2.

501. The CD2 binding molecule of embodiment 500, wherein ABM2 comprises the heavy chain variable sequence and the light chain variable sequence of NOV292.

502. The CD2 binding molecule of embodiment 500, wherein ABM2 comprises the heavy chain variable sequence and the light chain variable sequence of NOV123.

503. The CD2 binding molecule of embodiment 500, wherein ABM2 comprises the heavy chain variable sequence and the light chain variable sequence of Sp10b.

504. The CD2 binding molecule of embodiment 500, wherein ABM2 comprises the heavy chain variable sequence and the light chain variable sequence of NOV453.

505. The CD2 binding molecule of embodiment 500, wherein ABM2 comprises the heavy chain variable sequence and the light chain variable sequence of NOV229.

506. The CD2 binding molecule of embodiment 500, wherein ABM2 comprises the heavy chain variable sequence and the light chain variable sequence of NOV110.

507. The CD2 binding molecule of embodiment 500, wherein ABM2 comprises the heavy chain variable sequence and the light chain variable sequence of NOV832.

508. The CD2 binding molecule of embodiment 500, wherein ABM2 comprises the heavy chain variable sequence and the light chain variable sequence of NOV589.

509. The CD2 binding molecule of embodiment 500, wherein ABM2 comprises the heavy chain variable sequence and the light chain variable sequence of NOV580.

510. The CD2 binding molecule of embodiment 500, wherein ABM2 comprises the heavy chain variable sequence and the light chain variable sequence of NOV567.

511. The CD2 binding molecule of embodiment 500, wherein ABM2 comprises the heavy chain variable sequence and the light chain variable sequence of NOV221.

512. The CD2 binding molecule of embodiment 500, wherein ABM2 comprises the heavy chain variable sequence and the light chain variable sequence of CD3_sp11a_bkm1.

513. The CD2 binding molecule of embodiment 500, wherein ABM2 comprises the heavy chain variable sequence and the light chain variable sequence of CD3_SP11a_bkm2.

514. The CD2 binding molecule of embodiment 500, wherein ABM2 comprises the heavy chain variable sequence and the light chain variable sequence of CD3_sp11a_hz0.

515. The CD2 binding molecule of embodiment 500, wherein ABM2 comprises the heavy chain variable sequence and the light chain variable sequence of CD3_SP11A_HZ1.

516. The CD2 binding molecule of embodiment 500, wherein ABM2 comprises the heavy chain variable sequence and the light chain variable sequence of CD3_sp11a_sansPTM_hz1.

517. The CD2 binding molecule of embodiment 500, wherein ABM2 comprises the heavy chain variable sequence and the light chain variable sequence of CD3_sp11a_sansPTM_rat.

518. The CD2 binding molecule of embodiment 500, wherein ABM2 comprises the heavy chain variable sequence and the light chain variable sequence of CD3_sp11a_VHVL_YY.

519. The CD2 binding molecule of embodiment 500, wherein ABM2 comprises the heavy chain variable sequence and the light chain variable sequence of CD3_SP11A_VHVL_SS.

520. The CD2 binding molecule of embodiment 500, wherein ABM2 comprises the heavy chain variable sequence and the light chain variable sequence of CD3_SP11A_VHVL_WS.

521. The CD2 binding molecule of embodiment 500, wherein ABM2 comprises the heavy chain variable sequence and the light chain variable sequence of CD3_sp11a_VHVL_SW.

522. The CD2 binding molecule of embodiment 500, wherein ABM2 comprises the heavy chain variable sequence and the light chain variable sequence of CD3_SP11A_VHVL_TT.

523. The CD2 binding molecule of embodiment 500, wherein ABM2 comprises the heavy chain variable sequence and the light chain variable sequence of CD3_SP11A_VHVL_TW.

524. The CD2 binding molecule of embodiment 500, wherein ABM2 comprises the heavy chain variable sequence and the light chain variable sequence of CD3_SP11A_VHVL_WT.

525. The CD2 binding molecule of embodiment 500, wherein ABM2 comprises the heavy chain variable sequence and the light chain variable sequence of CD3_SP11A VH3_VLK_3.

526. The CD2 binding molecule of embodiment 500, wherein ABM2 comprises the heavy chain variable sequence and the light chain variable sequence of CD3_sp11a_VH1_VK2.

527. The CD2 binding molecule of embodiment 500, wherein ABM2 comprises the heavy chain variable sequence and the light chain variable sequence of CD3_SP11A_VH3_VLK1.

528. The CD2 binding molecule of embodiment 500, wherein ABM2 comprises the heavy chain variable sequence and the light chain variable sequence of CD3_SP11A_VH5_VK2.

529. The CD2 binding molecule of embodiment 500, wherein ABM2 comprises the heavy chain variable sequence and the light chain variable sequence of CD3_sp9aFW1_VL_VH_S56G.

530. The CD2 binding molecule of embodiment 500, wherein ABM2 comprises the heavy chain variable sequence and the light chain variable sequence of CD3_SP9AFW4_VL_VH_S56G.

531. The CD2 binding molecule of embodiment 500, wherein ABM2 comprises the heavy chain variable sequence and the light chain variable sequence of CD3_sp9aFW1_VL_VH.

532. The CD2 binding molecule of embodiment 500, wherein ABM2 comprises the heavy chain variable sequence and the light chain variable sequence of CD3_sp9aFW4_VLVH.

533. The CD2 binding molecule of embodiment 500, wherein ABM2 comprises the heavy chain variable sequence and the light chain variable sequence of CD3_sp9arabtor_VHVL.

534. The CD2 binding molecule of embodiment 500, wherein ABM2 comprises the heavy chain variable sequence and the light chain variable sequence of CD3_sp9arabtor_VLVH.

535. The CD2 binding molecule of embodiment 500, wherein ABM2 comprises the heavy chain variable sequence and the light chain variable sequence of CD3_sp11a_VHVL_YY_SANSPTM.

536. The CD2 binding molecule of embodiment 500, wherein ABM2 comprises the heavy chain variable sequence and the light chain variable sequence of CD3_sp11a_VHVL_YY_SANSPTM_Y.

537. The CD2 binding molecule of embodiment 500, wherein ABM2 comprises the heavy chain variable sequence and the light chain variable sequence of CD3_sp11a_VHVL_YY_SANSPTM_S.

538. The CD2 binding molecule of embodiment 500, wherein ABM2 comprises the heavy chain variable sequence and the light chain variable sequence of CD3_sp11a_VHVL_YY_Y.

539. The CD2 binding molecule of embodiment 500, wherein ABM2 comprises the heavy chain variable sequence and the light chain variable sequence of CD3_sp11a_VHVL_YY_s.

540. The CD2 binding molecule of embodiment 500, wherein ABM2 comprises the heavy chain variable sequence and the light chain variable sequence of CD3_sp11a_VHVL_SS_SANSPTM.

541. The CD2 binding molecule of embodiment 500, wherein ABM2 comprises the heavy chain variable sequence and the light chain variable sequence of CD3_sp11a_VHVL_SS_SANSPTM_Y.

542. The CD2 binding molecule of embodiment 500, wherein ABM2 comprises the heavy chain variable sequence and the light chain variable sequence of CD3_sp11a_VHVL_SS_SANSPTM_S.

543. The CD2 binding molecule of embodiment 500, wherein ABM2 comprises the heavy chain variable sequence and the light chain variable sequence of CD3_sp11a_VHVL_SS_Y.

544. The CD2 binding molecule of embodiment 500, wherein ABM2 comprises the heavy chain variable sequence and the light chain variable sequence of CD3_sp11a_VHVL_SS_S.

545. The CD2 binding molecule of embodiment 500, wherein ABM2 comprises the heavy chain variable sequence and the light chain variable sequence of CD3_sp11a_VHVL_SS_SANSPTM.

546. The CD2 binding molecule of embodiment 500, wherein ABM2 comprises the heavy chain variable sequence and the light chain variable sequence of CD3_sp11a_VHVL_WS_SANSPTM_Y.

547. The CD2 binding molecule of embodiment 500, wherein ABM2 comprises the heavy chain variable 548. The CD2 binding molecule of embodiment 500, wherein ABM2 comprises the heavy chain variable sequence and the light chain variable sequence of CD3_sp11a_VHVL_WS_Y.

549. The CD2 binding molecule of embodiment 500, wherein ABM2 comprises the heavy chain variable sequence and the light chain variable sequence of CD3_sp11a_VHVL_WS_S.

550. The CD2 binding molecule of embodiment 500, wherein ABM2 comprises the heavy chain variable sequence and the light chain variable sequence of CD3_sp11a_VHVL_WS_SANSPTM.

551. The CD2 binding molecule of embodiment 500, wherein ABM2 comprises the heavy chain variable sequence and the light chain variable sequence of CD3_sp11a_VHVL_SW_SANSPTM_Y.

552. The CD2 binding molecule of embodiment 500, wherein ABM2 comprises the heavy chain variable sequence and the light chain variable sequence of CD3_sp11a_VHVL_SW_SANSPTM_S.

553. The CD2 binding molecule of embodiment 500, wherein ABM2 comprises the heavy chain variable sequence and the light chain variable sequence of CD3_sp11a_VHVL_SW_Y.

554. The CD2 binding molecule of embodiment 500, wherein ABM2 comprises the heavy chain variable sequence and the light chain variable sequence of CD3_sp11a_VHVL_SW_S.

555. The CD2 binding molecule of embodiment 500, wherein ABM2 comprises the heavy chain variable sequence and the light chain variable sequence of CD3_sp11a_VHVL_SW_SANSPTM.

556. The CD2 binding molecule of embodiment 500, wherein ABM2 comprises the heavy chain variable sequence and the light chain variable sequence of CD3_sp11a_VHVL_TW_SANSPTM_Y.

557. The CD2 binding molecule of embodiment 500, wherein ABM2 comprises the heavy chain variable sequence and the light chain variable sequence of CD3_sp11a_VHVL_TW_SANSPTM_S.

558. The CD2 binding molecule of embodiment 500, wherein ABM2 comprises the heavy chain variable sequence and the light chain variable sequence of CD3_sp11a_VHVL_TW_Y.

559. The CD2 binding molecule of embodiment 500, wherein ABM2 comprises the heavy chain variable sequence and the light chain variable sequence of CD3_sp11a_VHVL_TW_S.

560. The CD2 binding molecule of embodiment 500, wherein ABM2 comprises the heavy chain variable sequence and the light chain variable sequence of CD3_sp11a_VHVL_TW_SANSPTM.

561. The CD2 binding molecule of embodiment 500, wherein ABM2 comprises the heavy chain variable sequence and the light chain variable sequence of CD3_sp11a_VHVL_TT_SANSPTM_Y.

562. The CD2 binding molecule of embodiment 500, wherein ABM2 comprises the heavy chain variable sequence and the light chain variable sequence of CD3_sp11a_VHVL_TT_SANSPTM_S.

563. The CD2 binding molecule of embodiment 500, wherein ABM2 comprises the heavy chain variable sequence and the light chain variable sequence of CD3_sp11a_VHVL_TT_Y.

564. The CD2 binding molecule of embodiment 500, wherein ABM2 comprises the heavy chain variable sequence and the light chain variable sequence of CD3_sp11a_VHVL_TT_S.

565. The CD2 binding molecule of embodiment 500, wherein ABM2 comprises the heavy chain variable sequence and the light chain variable sequence of CD3_sp11a_VHVL_TT_SANSPTM.

566. The CD2 binding molecule of embodiment 500, wherein ABM2 comprises the heavy chain variable sequence and the light chain variable sequence of CD3_SP11AVH3_VLK_3_Y.

567. The CD2 binding molecule of embodiment 500, wherein ABM2 comprises the heavy chain variable sequence and the light chain variable sequence of CD3_SP11AVH3_VLK_3_S.

568. The CD2 binding molecule of embodiment 500, wherein ABM2 comprises the heavy chain variable sequence and the light chain variable sequence of CD3_SP11AVH3_VLK_3_Y_PTM.

569. The CD2 binding molecule of embodiment 500, wherein ABM2 comprises the heavy chain variable sequence and the light chain variable sequence of CD3_SP11AVH3_VLK_3_S_PTM.

570. The CD2 binding molecule of embodiment 500, wherein ABM2 comprises the heavy chain variable sequence and the light chain variable sequence of CD3_SP11AVH3_VLK_3_Y_SW.

571. The CD2 binding molecule of embodiment 500, wherein ABM2 comprises the heavy chain variable sequence and the light chain variable sequence of CD3_SP11AVH3_VLK_3_S_SW.

572. The CD2 binding molecule of embodiment 500, wherein ABM2 comprises the heavy chain variable sequence and the light chain variable sequence of CD3_SP11AVH3_VLK_3_Y_PTM_SW.

573. The CD2 binding molecule of embodiment 500, wherein ABM2 comprises the heavy chain variable sequence and the light chain variable sequence of CD3_SP11AVH3_VLK_3_S_SWPTM.

574. The CD2 binding molecule of embodiment 500, wherein ABM2 comprises the heavy chain variable sequence and the light chain variable sequence of CD3_SP11AVH3_VLK_SWPTM.

575. The CD2 binding molecule of embodiment 500, wherein ABM2 comprises the heavy chain variable sequence and the light chain variable sequence of CD3_SP11AVH3_VLK_3_SW.

576. The CD2 binding molecule of embodiment 500, wherein ABM2 comprises the heavy chain variable sequence and the light chain variable sequence of CD3_sp11a_VH1_VK2_Y.

577. The CD2 binding molecule of embodiment 500, wherein ABM2 comprises the heavy chain variable sequence and the light chain variable sequence of CD3_sp11a_VH1_VK2_S.

578. The CD2 binding molecule of embodiment 500, wherein ABM2 comprises the heavy chain variable sequence and the light chain variable sequence of CD3_sp11a_VH1_VK2_Y_PTM.

579. The CD2 binding molecule of embodiment 500, wherein ABM2 comprises the heavy chain variable sequence and the light chain variable sequence of CD3_sp11a_VH1_VK2_S_PTM.

580. The CD2 binding molecule of embodiment 500, wherein ABM2 comprises the heavy chain variable sequence and the light chain variable sequence of CD3_sp11a_VH1_VK2_Y_SW.

581. The CD2 binding molecule of embodiment 500, wherein ABM2 comprises the heavy chain variable sequence and the light chain variable sequence of CD3_sp11a_VH1_VK2_S_SW.

582. The CD2 binding molecule of embodiment 500, wherein ABM2 comprises the heavy chain variable sequence and the light chain variable sequence of CD3_sp11a_VH1_VK2_Y_PTM.

583. The CD2 binding molecule of embodiment 500, wherein ABM2 comprises the heavy chain variable sequence and the light chain variable sequence of CD3_sp11a_VH1_VK2_S_PTM_SW.

584. The CD2 binding molecule of embodiment 500, wherein ABM2 comprises the heavy chain variable sequence and the light chain variable sequence of CD3_sp11a_VH1_VK2_SW.

585. The CD2 binding molecule of embodiment 500, wherein ABM2 comprises the heavy chain variable sequence and the light chain variable sequence of CD3_sp11a_VH1_VK2_SW PTM.

586. The CD2 binding molecule of embodiment 500, wherein ABM2 comprises the heavy chain variable sequence and the light chain variable sequence of CD3_SP11A_VH3_VLK1_Y.

587. The CD2 binding molecule of embodiment 500, wherein ABM2 comprises the heavy chain variable sequence and the light chain variable sequence of CD3_SP11A_VH3_VLK1_S.

588. The CD2 binding molecule of embodiment 500, wherein ABM2 comprises the heavy chain variable sequence and the light chain variable sequence of CD3_SP11A_VH3_VLK1_Y_PTM.

589. The CD2 binding molecule of embodiment 500, wherein ABM2 comprises the heavy chain variable sequence and the light chain variable sequence of CD3_SP11A_VH3_VLK1_S_PTM.

590. The CD2 binding molecule of embodiment 500, wherein ABM2 comprises the heavy chain variable sequence and the light chain variable sequence of CD3_SP11A_VH3_VLK1_Y_SW.

591. The CD2 binding molecule of embodiment 500, wherein ABM2 comprises the heavy chain variable sequence and the light chain variable sequence of CD3_SP11A_VH3_VLK1_S_SW.

592. The CD2 binding molecule of embodiment 500, wherein ABM2 comprises the heavy chain variable sequence and the light chain variable sequence of CD3_SP11A_VH3_VLK1_Y_PTM.

593. The CD2 binding molecule of embodiment 500, wherein ABM2 comprises the heavy chain variable sequence and the light chain variable sequence of CD3_SP11A_VH3_VLK1_S_PTM_SW.

594. The CD2 binding molecule of embodiment 500, wherein ABM2 comprises the heavy chain variable sequence and the light chain variable sequence of CD3_SP11A_VH3_VLK1PTM_SW.

595. The CD2 binding molecule of embodiment 500, wherein ABM2 comprises the heavy chain variable sequence and the light chain variable sequence of CD3_SP11A_VH3_VLK1_SW.

596. The CD2 binding molecule of embodiment 500, wherein ABM2 comprises the heavy chain variable sequence and the light chain variable sequence of CD3_SP11A_VH5_VK2_Y.

597. The CD2 binding molecule of embodiment 500, wherein ABM2 comprises the heavy chain variable sequence and the light chain variable sequence of CD3_SP11A_VH5_VK2_S.

598. The CD2 binding molecule of embodiment 500, wherein ABM2 comprises the heavy chain variable sequence and the light chain variable sequence of CD3_SP11A_VH5_VK2_Y_PTM.

599. The CD2 binding molecule of embodiment 500, wherein ABM2 comprises the heavy chain variable sequence and the light chain variable sequence of CD3_SP11A_VH5_VK2_S_PTM.

600. The CD2 binding molecule of embodiment 500, wherein ABM2 comprises the heavy chain variable sequence and the light chain variable sequence of CD3_SP11A_VH5_VK2_Y_SW.

601. The CD2 binding molecule of embodiment 500, wherein ABM2 comprises the heavy chain variable sequence and the light chain variable sequence of CD3_SP11A_VH5_VK2_S_SW.

602. The CD2 binding molecule of embodiment 500, wherein ABM2 comprises the heavy chain variable sequence and the light chain variable sequence of CD3_SP11A_VH5_VK2_Y_PTM_SW.

The CD2 binding molecule of embodiment 500, wherein ABM2 comprises the heavy chain variable sequence and the light chain variable sequence of CD3_SP11A_VH5_VK2_S_PTM_SW.

604. The CD2 binding molecule of embodiment 500, wherein ABM2 comprises the heavy chain variable sequence and the light chain variable sequence of CD3_SP11A_VH5_VK2_PTM_SW.

605. The CD2 binding molecule of embodiment 500, wherein ABM2 comprises the heavy chain variable sequence and the light chain variable sequence of CD3_SP11A_VH5_VK2_SW.

606. The CD2 binding molecule of embodiment 31, wherein the component of the TCR complex is TCR-α, TCR-β, or a TCR-α/β dimer.

607. The CD2 binding molecule of embodiment 606, wherein ABM2 is an antibody or an antigen-binding domain thereof.

608. The CD2 binding molecule of embodiment 607, wherein ABM2 comprises the CDR sequences of BMA031.

609. The CD2 binding molecule of embodiment 608, wherein the CDR sequences are defined as in Table 13.

610. The CD2 binding molecule of embodiment 609, wherein the CDR sequences are defined by Kabat numbering, as set forth in Table 13.

611. The CD2 binding molecule of embodiment 609, wherein the CDR sequences are defined by IMGT numbering, as set forth in Table 13.

612. The CD2 binding molecule of embodiment 609, wherein the CDR sequences are defined by Chothia numbering, as set forth in Table 13.

613. The CD2 binding molecule of embodiment 609, wherein the CDR sequences are defined by a combination of Kabat and Chothia numbering, as set forth in Table 13.

614. The CD2 binding molecule of embodiment 607, wherein ABM2 comprises the heavy and light chain variable sequences of BMA031.

615. The CD2 binding molecule of embodiment 31, wherein the component of the TCR complex is TCR-γ, TCR-δ, or a TCR-γ/δ dimer.

616. The CD2 binding molecule of embodiment 615, wherein ABM2 is an antibody or an antigen-binding domain thereof.

617. The CD2 binding molecule of embodiment 616, wherein ABM2 comprises the CDR sequences of δTCS1.

618. The CD2 binding molecule of embodiment 617, wherein the CDR sequences are defined by Kabat numbering.

619. The CD2 binding molecule of embodiment 617, wherein the CDR sequences are defined by Chothia numbering.

620. The CD2 binding molecule of embodiment 617, wherein the CDR sequences are defined by a combination of Kabat and Chothia numbering.

621. The CD2 binding molecule of embodiment 616, wherein ABM2 comprises the heavy and light chain variable sequences of δTCS1.

622. The CD2 binding molecule of embodiment 30, wherein ABM2 binds specifically to a TAA.

623. The CD2 binding molecule of embodiment 622, wherein ABM2 is an anti-TAA antibody or an antigen-binding domain thereof.

624. The CD2 binding molecule of embodiment 623, wherein the TAA is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

625. The CD2 binding molecule of embodiment 624, wherein the anti-TAA antibody or antigen-binding domain thereof has the CDR sequences of an antibody set forth in Table 14A or Table 14B.

626. The CD2 binding molecule of embodiment 624, wherein the anti-TAA antibody or antigen-binding domain thereof has the heavy and light chain variable region sequences of an antibody set forth in Table 14A or Table 14B.

627. The CD2 binding molecule of embodiment 625 or embodiment 626, wherein the anti-TAA antibody or antigen-binding domain thereof binds to CD22.

628. The CD2 binding molecule of embodiment 625 or embodiment 626, wherein the anti-TAA antibody or antigen-binding domain thereof binds to CS1.

629. The CD2 binding molecule of embodiment 625 or embodiment 626, wherein the anti-TAA antibody or antigen-binding domain thereof binds to CD33.

630. The CD2 binding molecule of embodiment 625 or embodiment 626, wherein the anti-TAA antibody or antigen-binding domain thereof binds to GD2.

631. The CD2 binding molecule of embodiment 625 or embodiment 626, wherein the anti-TAA antibody or antigen-binding domain thereof binds to BCMA.

632. The CD2 binding molecule of embodiment 625 or embodiment 626, wherein the anti-TAA antibody or antigen-binding domain thereof binds to Tn.

633. The CD2 binding molecule of embodiment 625 or embodiment 626, wherein the anti-TAA antibody or antigen-binding domain thereof binds to PSMA.

634. The CD2 binding molecule of embodiment 625 or embodiment 626, wherein the anti-TAA antibody or antigen-binding domain thereof binds to ROR1.

635. The CD2 binding molecule of embodiment 625 or embodiment 626, wherein the anti-TAA antibody or antigen-binding domain thereof binds to FLT3.

636. The CD2 binding molecule of embodiment 625 or embodiment 626, wherein the anti-TAA antibody or antigen-binding domain thereof binds to TAAG72.

637. The CD2 binding molecule of embodiment 625 or embodiment 626, wherein the anti-TAA antibody or antigen-binding domain thereof binds to FAP.

638. The CD2 binding molecule of embodiment 625 or embodiment 626, wherein the anti-TAA antibody or antigen-binding domain thereof binds to CD38.

639. The CD2 binding molecule of embodiment 625 or embodiment 626, wherein the anti-TAA antibody or antigen-binding domain thereof binds to CD44v6.

640. The CD2 binding molecule of embodiment 625 or embodiment 626, wherein the anti-TAA antibody or antigen-binding domain thereof binds to CEA.

641. The CD2 binding molecule of embodiment 625 or embodiment 626, wherein the anti-TAA antibody or antigen-binding domain thereof binds to EPCAM.

642. The CD2 binding molecule of embodiment 625 or embodiment 626, wherein the anti-TAA antibody or antigen-binding domain thereof binds to PRSS21.

643. The CD2 binding molecule of embodiment 625 or embodiment 626, wherein the anti-TAA antibody or antigen-binding domain thereof binds to B7H3.

644. The CD2 binding molecule of embodiment 625 or embodiment 626, wherein the anti-TAA antibody or antigen-binding domain thereof binds to KIT.

645. The CD2 binding molecule of embodiment 625 or embodiment 626, wherein the anti-TAA antibody or antigen-binding domain thereof binds to IL-13Ra2.

646. The CD2 binding molecule of embodiment 625 or embodiment 626, wherein the anti-TAA antibody or antigen-binding domain thereof binds to CD30.

647. The CD2 binding molecule of embodiment 625 or embodiment 626, wherein the anti-TAA antibody or antigen-binding domain thereof binds to GD3.

648. The CD2 binding molecule of embodiment 625 or embodiment 626, wherein the anti-TAA antibody or antigen-binding domain thereof binds to CD171.

649. The CD2 binding molecule of embodiment 625 or embodiment 626, wherein the anti-TAA antibody or antigen-binding domain thereof binds to IL-11Ra.

650. The CD2 binding molecule of embodiment 625 or embodiment 626, wherein the anti-TAA antibody or antigen-binding domain thereof binds to PSCA.

651. The CD2 binding molecule of embodiment 625 or embodiment 626, wherein the anti-TAA antibody or antigen-binding domain thereof binds to VEGFR2.

652. The CD2 binding molecule of embodiment 625 or embodiment 626, wherein the anti-TAA antibody or antigen-binding domain thereof binds to LewisY.

653. The CD2 binding molecule of embodiment 625 or embodiment 626, wherein the anti-TAA antibody or antigen-binding domain thereof binds to CD24.

654. The CD2 binding molecule of embodiment 625 or embodiment 626, wherein the anti-TAA antibody or antigen-binding domain thereof binds to PDGFR-beta.

655. The CD2 binding molecule of embodiment 625 or embodiment 626, wherein the anti-TAA antibody or antigen-binding domain thereof binds to SSEA-4.

656. The CD2 binding molecule of embodiment 625 or embodiment 626, wherein the anti-TAA antibody or antigen-binding domain thereof binds to CD20.

657. The CD2 binding molecule of embodiment 625 or embodiment 626, wherein the anti-TAA antibody or antigen-binding domain thereof binds to folate receptor alpha.

658. The CD2 binding molecule of embodiment 625 or embodiment 626, wherein the anti-TAA antibody or antigen-binding domain thereof binds to ERBB2.

659. The CD2 binding molecule of embodiment 625 or embodiment 626, wherein the anti-TAA antibody or antigen-binding domain thereof binds to MUC1.

660. The CD2 binding molecule of embodiment 625 or embodiment 626, wherein the anti-TAA antibody or antigen-binding domain thereof binds to EGFR.

661. The CD2 binding molecule of embodiment 625 or embodiment 626, wherein the anti-TAA antibody or antigen-binding domain thereof binds to NCAM.

662. The CD2 binding molecule of embodiment 625 or embodiment 626, wherein the anti-TAA antibody or antigen-binding domain thereof binds to ephrin B2

663. The CD2 binding molecule of embodiment 625 or embodiment 626, wherein the anti-TAA antibody or antigen-binding domain thereof binds to IGF-I receptor.

664. The CD2 binding molecule of embodiment 625 or embodiment 626, wherein the anti-TAA antibody or antigen-binding domain thereof binds to CAIX.

665. The CD2 binding molecule of embodiment 625 or embodiment 626, wherein the anti-TAA antibody or antigen-binding domain thereof binds to LMP2.

666. The CD2 binding molecule of embodiment 625 or embodiment 626, wherein the anti-TAA antibody or antigen-binding domain thereof binds to gp100.

667. The CD2 binding molecule of embodiment 625 or embodiment 626, wherein the anti-TAA antibody or antigen-binding domain thereof binds to tyrosinase.

668. The CD2 binding molecule of embodiment 625 or embodiment 626, wherein the anti-TAA antibody or antigen-binding domain thereof binds to ephA2.

669. The CD2 binding molecule of embodiment 625 or embodiment 626, wherein the anti-TAA antibody or antigen-binding domain thereof binds to mesothelin.

670. The CD2 binding molecule of embodiment 625 or embodiment 626, wherein the anti-TAA antibody or antigen-binding domain thereof binds to ALK.

671. The CD2 binding molecule of embodiment 625 or embodiment 626, wherein the anti-TAA antibody or antigen-binding domain thereof binds to CD19.

672. The CD2 binding molecule of embodiment 625 or embodiment 626, wherein the anti-TAA antibody or antigen-binding domain thereof binds to CD97.

673. The CD2 binding molecule of embodiment 625 or embodiment 626, wherein the anti-TAA antibody or antigen-binding domain thereof binds to CLDN6.

674. The CD2 binding molecule of embodiment 625 or embodiment 626, wherein the anti-TAA antibody or antigen-binding domain thereof binds to EGFRvIII.

675. The CD2 binding molecule of embodiment 625 or embodiment 626, wherein the anti-TAA antibody or antigen-binding domain thereof binds to folate receptor beta.

676. The CD2 binding molecule of embodiment 625 or embodiment 626, wherein the anti-TAA antibody or antigen-binding domain thereof binds to GloboH.

677. The CD2 binding molecule of embodiment 625 or embodiment 626, wherein the anti-TAA antibody or antigen-binding domain thereof binds to GPRC5D.

678. The CD2 binding molecule of embodiment 625 or embodiment 626, wherein the anti-TAA antibody or antigen-binding domain thereof binds to HMWMAA.

679. The CD2 binding molecule of embodiment 625 or embodiment 626, wherein the anti-TAA antibody or antigen-binding domain thereof binds to LRP6.

680. The CD2 binding molecule of embodiment 625 or embodiment 626, wherein the anti-TAA antibody or antigen-binding domain thereof binds to NY-BR-1.

681. The CD2 binding molecule of embodiment 625 or embodiment 626, wherein the anti-TAA antibody or antigen-binding domain thereof binds to PLAC1.

682. The CD2 binding molecule of embodiment 625 or embodiment 626, wherein the anti-TAA antibody or antigen-binding domain thereof binds to polysialic acid.

683. The CD2 binding molecule of embodiment 625 or embodiment 626, wherein the anti-TAA antibody or antigen-binding domain thereof binds to TEM1/CD248.

684. The CD2 binding molecule of embodiment 625 or embodiment 626, wherein the anti-TAA antibody or antigen-binding domain thereof binds to TSHR.

685. The CD2 binding molecule of embodiment 623, wherein the TAA is CD19.

686. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequence of the anti-CD19 antibody NEG258 as defined by Kabat and set forth in Table 17A.

687. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequences of the anti-CD19 antibody NEG258 as defined by Chothia and set forth in Table 17A.

688. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequence of the anti-CD19 antibody NEG258 as defined by IMGT and set forth in Table 17A.

689. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequences of the anti-CD19 antibody NEG258 as defined by the combination of Kabat and Chothia and set forth in Table 17A.

690. The CD2 binding molecule of embodiment 685, wherein the anti-TAA antibody or antigen-binding domain thereof comprises the heavy chain and/or light chain variable sequences of the anti-CD19 antibody NEG258 as set forth in Table 17A.

691. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequence of the anti-CD19 antibody NEG218 as defined by Kabat and set forth in Table 17B.

692. The CD2 binding molecule of embodiment 685, wherein the anti-TAA antibody or antigen-binding domain thereof comprises the CDR-H1, CDR-H2, CDR-H3, CDR- L1, CDR-L2, and CDR-L3 sequences of the anti-CD19 antibody NEG218 as defined by Chothia and set forth in Table 17B.

693. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequence of the anti-CD19 antibody NEG218 as defined by IMGT and set forth in Table 17B.

694. The CD2 binding molecule of embodiment 685, wherein the anti-TAA antibody or antigen-binding domain thereof comprises the CDR-H1, CDR-H2, CDR-H3, CDR-L1, CDR-L2, and CDR-L3 sequences of the anti-CD19 antibody NEG218 as defined by the combination of Kabat and Chothia and set forth in Table 17B.

695. The CD2 binding molecule of embodiment 685, wherein the anti-TAA antibody or antigen-binding domain thereof comprises the heavy chain and/or light chain variable sequences of the anti-CD19 antibody NEG218 as set forth in Table 17B.

696. The CD2 binding molecule of embodiment 685, wherein the anti-TAA antibody or antigen-binding domain thereof comprises heavy chain CDRs having the amino acid sequences of CD19-H1, CD19-H2A, and CD19-H3 as set forth in Table 16 and light chain CDRs having the amino acid sequences of CD19-L1, CD19-L2, and CD19-L3 as set forth in Table 16.

697. The CD2 binding molecule of embodiment 685, wherein the anti-TAA antibody or antigen-binding domain thereof comprises a heavy chain variable region having the amino acid sequences of VHA as set forth in Table 16 and a light chain variable region having the amino acid sequences of VLA as set forth in Table 16.

698. The CD2 binding molecule of embodiment 685, wherein the anti-TAA antibody or antigen-binding domain thereof comprises heavy chain CDRs having the amino acid sequences of CD19-H1, CD19-H2B, and CD19-H3 as set forth in Table 16 and light chain CDRs having the amino acid sequences of CD19-L1, CD19-L2, and CD19-L3 as set forth in Table 16.

699. The CD2 binding molecule of embodiment 685, wherein the anti-TAA antibody or antigen-binding domain thereof comprises a heavy chain variable region having the amino acid sequences of VHB as set forth in Table 16 and a light chain variable region having the amino acid sequences of VLB as set forth in Table 16.

700. The CD2 binding molecule of embodiment 685, wherein the anti-TAA antibody or antigen-binding domain thereof comprises heavy chain CDRs having the amino acid sequences of CD19-H1, CD19-H2C, and CD19-H3 as set forth in Table 16 and light chain CDRs having the amino acid sequences of CD19-L1, CD19-L2, and CD19-L3 as set forth in Table 16.

701. The CD2 binding molecule of embodiment 685, wherein the anti-TAA antibody or antigen-binding domain thereof comprises a heavy chain variable region having the amino acid sequences of VHC as set forth in Table 16 and a light chain variable region having the amino acid sequences of VLB as set forth in Table 16.

702. The CD2 binding molecule of embodiment 685, wherein the anti-TAA antibody or antigen-binding domain thereof comprises heavy chain CDRs having the amino acid sequences of CD19-H1, CD19-H2D, and CD19-H3 as set forth in Table 16 and light chain CDRs having the amino acid sequences of CD19-L1, CD19-L2, and CD19-L3 as set forth in Table 16.

703. The CD2 binding molecule of embodiment 685, wherein the anti-TAA antibody or antigen-binding domain thereof comprises a heavy chain variable region having the amino acid sequences of VHD as set forth in Table 16 and a light chain variable region having the amino acid sequences of VLB as set forth in Table 16.

704. The CD2 binding molecule of embodiment 623, wherein the TAA is Her2.

705. The CD2 binding molecule of embodiment 623, wherein the TAA is mesothelin.

706. The CD2 binding molecule of embodiment 623, wherein the TAA is BCMA.

707. The CD2 binding molecule of embodiment 706, wherein ABM2 comprises the CDR sequences of BCMA-1.

708. The CD2 binding molecule of embodiment 706, wherein ABM2 comprises the CDR sequences of BCMA-2.

709. The CD2 binding molecule of embodiment 706, wherein ABM2 comprises the CDR sequences of BCMA-3.

710. The CD2 binding molecule of embodiment 706, wherein ABM2 comprises the CDR sequences of BCMA-4.

711. The CD2 binding molecule of embodiment 706, wherein ABM2 comprises the CDR sequences of BCMA-5.

712. The CD2 binding molecule of embodiment 706, wherein ABM2 comprises the CDR sequences of BCMA-6.

713. The CD2 binding molecule of embodiment 706, wherein ABM2 comprises the CDR sequences of BCMA-7.

714. The CD2 binding molecule of embodiment 706, wherein ABM2 comprises the CDR sequences of BCMA-8.

715. The CD2 binding molecule of embodiment 706, wherein ABM2 comprises the CDR sequences of BCMA-9.

716. The CD2 binding molecule of embodiment 706, wherein ABM2 comprises the CDR sequences of BCMA-10.

717. The CD2 binding molecule of embodiment 706, wherein ABM2 comprises the CDR sequences of BCMA-11.

718. The CD2 binding molecule of embodiment 706, wherein ABM2 comprises the CDR sequences of BCMA-12.

719. The CD2 binding molecule of embodiment 706, wherein ABM2 comprises the CDR sequences of BCMA-13.

720. The CD2 binding molecule of embodiment 706, wherein ABM2 comprises the CDR sequences of BCMA-14.

721. The CD2 binding molecule of embodiment 706, wherein ABM2 comprises the CDR sequences of BCMA-15.

722. The CD2 binding molecule of embodiment 706, wherein ABM2 comprises the CDR sequences of BCMA-16.

723. The CD2 binding molecule of embodiment 706, wherein ABM2 comprises the CDR sequences of BCMA-17.

724. The CD2 binding molecule of embodiment 706, wherein ABM2 comprises the CDR sequences of BCMA-18.

725. The CD2 binding molecule of embodiment 706, wherein ABM2 comprises the CDR sequences of BCMA-19.

726. The CD2 binding molecule of embodiment 706, wherein ABM2 comprises the CDR sequences of BCMA-20.

727. The CD2 binding molecule of embodiment 706, wherein ABM2 comprises the CDR sequences of BCMA-21.

728. The CD2 binding molecule of embodiment 706, wherein ABM2 comprises the CDR sequences of BCMA-22.

729. The CD2 binding molecule of embodiment 706, wherein ABM2 comprises the CDR sequences of BCMA-23.

730. The CD2 binding molecule of embodiment 706, wherein ABM2 comprises the CDR sequences of BCMA-24.

731. The CD2 binding molecule of embodiment 706, wherein ABM2 comprises the CDR sequences of BCMA-25.

732. The CD2 binding molecule of embodiment 706, wherein ABM2 comprises the CDR sequences of BCMA-26.

733. The CD2 binding molecule of embodiment 706, wherein ABM2 comprises the CDR sequences of BCMA-27.

734. The CD2 binding molecule of embodiment 706, wherein ABM2 comprises the CDR sequences of BCMA-28.

735. The CD2 binding molecule of embodiment 706, wherein ABM2 comprises the CDR sequences of BCMA-29.

736. The CD2 binding molecule of embodiment 706, wherein ABM2 comprises the CDR sequences of BCMA-30.

737. The CD2 binding molecule of embodiment 706, wherein ABM2 comprises the CDR sequences of BCMA-31.

738. The CD2 binding molecule of embodiment 706, wherein ABM2 comprises the CDR sequences of BCMA-32.

739. The CD2 binding molecule of embodiment 706, wherein ABM2 comprises the CDR sequences of BCMA-33.

740. The CD2 binding molecule of embodiment 706, wherein ABM2 comprises the CDR sequences of BCMA-34.

741. The CD2 binding molecule of embodiment 706, wherein ABM2 comprises the CDR sequences of BCMA-35.

742. The CD2 binding molecule of embodiment 706, wherein ABM2 comprises the CDR sequences of BCMA-36.

743. The CD2 binding molecule of embodiment 706, wherein ABM2 comprises the CDR sequences of BCMA-37.

744. The CD2 binding molecule of embodiment 706, wherein ABM2 comprises the CDR sequences of BCMA-38.

745. The CD2 binding molecule of embodiment 706, wherein ABM2 comprises the CDR sequences of BCMA-39.

746. The CD2 binding molecule of embodiment 706, wherein ABM2 comprises the CDR sequences of BCMA-40.

747. The CD2 binding molecule of any one of embodiments 707 to 746, wherein the CDRs are defined by Kabat numbering, as set forth in Tables 15B and 15E.

748. The CD2 binding molecule of any one of embodiments 707 to 746, wherein the CDRs are defined by Chothia numbering, as set forth in Tables 15C and 15F.

749. CD2 binding molecule of any one of embodiments 707 to 746, wherein the CDRs are defined by a combination of Kabat and Chothia numbering, as set forth in Tables 15D and 15G.

750. The CD2 binding molecule of embodiment 706, wherein ABM2 comprises the heavy and light chain variable sequences of BCMA-1, as set forth in Table 15A.

751. The CD2 binding molecule of embodiment 706, wherein ABM2 comprises the heavy and light chain variable sequences of BCMA-2, as set forth in Table 15A.

752. The CD2 binding molecule of embodiment 706, wherein ABM2 comprises the heavy and light chain variable sequences of BCMA-3, as set forth in Table 15A.

753. The CD2 binding molecule of embodiment 706, wherein ABM2 comprises the heavy and light chain variable sequences of BCMA-4, as set forth in Table 15A.

754. The CD2 binding molecule of embodiment 706, wherein ABM2 comprises the heavy and light chain variable sequences of BCMA-5, as set forth in Table 15A.

755. The CD2 binding molecule of embodiment 706, wherein ABM2 comprises the heavy and light chain variable sequences of BCMA-6, as set forth in Table 15A.

756. The CD2 binding molecule of embodiment 706, wherein ABM2 comprises the heavy and light chain variable sequences of BCMA-7, as set forth in Table 15A.

757. The CD2 binding molecule of embodiment 706, wherein ABM2 comprises the heavy and light chain variable sequences of BCMA-8, as set forth in Table 15A.

758. The CD2 binding molecule of embodiment 706, wherein ABM2 comprises the heavy and light chain variable sequences of BCMA-9, as set forth in Table 15A.

759. The CD2 binding molecule of embodiment 706, wherein ABM2 comprises the heavy and light chain variable sequences of BCMA-10, as set forth in Table 15A.

760. The CD2 binding molecule of embodiment 706, wherein ABM2 comprises the heavy and light chain variable sequences of BCMA-11, as set forth in Table 15A.

761. The CD2 binding molecule of embodiment 706, wherein ABM2 comprises the heavy and light chain variable sequences of BCMA-12, as set forth in Table 15A.

762. The CD2 binding molecule of embodiment 706, wherein ABM2 comprises the heavy and light chain variable sequences of BCMA-13, as set forth in Table 15A.

763. The CD2 binding molecule of embodiment 706, wherein ABM2 comprises the heavy and light chain variable sequences of BCMA-14, as set forth in Table 15A.

764. The CD2 binding molecule of embodiment 706, wherein ABM2 comprises the heavy and light chain variable sequences of BCMA-15, as set forth in Table 15A.

765. The CD2 binding molecule of embodiment 706, wherein ABM2 comprises the heavy and light chain variable sequences of BCMA-16, as set forth in Table 15A.

766. The CD2 binding molecule of embodiment 706, wherein ABM2 comprises the heavy and light chain variable sequences of BCMA-17, as set forth in Table 15A.

767. The CD2 binding molecule of embodiment 706, wherein ABM2 comprises the heavy and light chain variable sequences of BCMA-18, as set forth in Table 15A.

768. The CD2 binding molecule of embodiment 706, wherein ABM2 comprises the heavy and light chain variable sequences of BCMA-19, as set forth in Table 15A.

769. The CD2 binding molecule of embodiment 706, wherein ABM2 comprises the heavy and light chain variable sequences of BCMA-20, as set forth in Table 15A.

770. The CD2 binding molecule of embodiment 706, wherein ABM2 comprises the heavy and light chain variable sequences of BCMA-21, as set forth in Table 15A.

771. The CD2 binding molecule of embodiment 706, wherein ABM2 comprises the heavy and light chain variable sequences of BCMA-22, as set forth in Table 15A.

772. The CD2 binding molecule of embodiment 706, wherein ABM2 comprises the heavy and light chain variable sequences of BCMA-23, as set forth in Table 15A.

773. The CD2 binding molecule of embodiment 706, wherein ABM2 comprises the heavy and light chain variable sequences of BCMA-24, as set forth in Table 15A.

774. The CD2 binding molecule of embodiment 706, wherein ABM2 comprises the heavy and light chain variable sequences of BCMA-25, as set forth in Table 15A.

775. The CD2 binding molecule of embodiment 706, wherein ABM2 comprises the heavy and light chain variable sequences of BCMA-26, as set forth in Table 15A.

776. The CD2 binding molecule of embodiment 706, wherein ABM2 comprises the heavy and light chain variable sequences of BCMA-27, as set forth in Table 15A.

777. The CD2 binding molecule of embodiment 706, wherein ABM2 comprises the heavy and light chain variable sequences of BCMA-28, as set forth in Table 15A.

778. The CD2 binding molecule of embodiment 706, wherein ABM2 comprises the heavy and light chain variable sequences of BCMA-29, as set forth in Table 15A.

779. The CD2 binding molecule of embodiment 706, wherein ABM2 comprises the heavy and light chain variable sequences of BCMA-30, as set forth in Table 15A.

780. The CD2 binding molecule of embodiment 706, wherein ABM2 comprises the heavy and light chain variable sequences of BCMA-31, as set forth in Table 15A.

781. The CD2 binding molecule of embodiment 706, wherein ABM2 comprises the heavy and light chain variable sequences of BCMA-32, as set forth in Table 15A.

782. The CD2 binding molecule of embodiment 706, wherein ABM2 comprises the heavy and light chain variable sequences of BCMA-33, as set forth in Table 15A.

783. The CD2 binding molecule of embodiment 706, wherein ABM2 comprises the heavy and light chain variable sequences of BCMA-34, as set forth in Table 15A.

784. The CD2 binding molecule of embodiment 706, wherein ABM2 comprises the heavy and light chain variable sequences of BCMA-35, as set forth in Table 15A.

785. The CD2 binding molecule of embodiment 706, wherein ABM2 comprises the heavy and light chain variable sequences of BCMA-36, as set forth in Table 15A.

786. The CD2 binding molecule of embodiment 706, wherein ABM2 comprises the heavy and light chain variable sequences of BCMA-37, as set forth in Table 15A.

787. The CD2 binding molecule of embodiment 706, wherein ABM2 comprises the heavy and light chain variable sequences of BCMA-38, as set forth in Table 15A.

788. The CD2 binding molecule of embodiment 706, wherein ABM2 comprises the heavy and light chain variable sequences of BCMA-39, as set forth in Table 15A.

789. The CD2 binding molecule of embodiment 706, wherein ABM2 comprises the heavy and light chain variable sequences of BCMA-40, as set forth in Table 15A.

790. The CD2 binding molecule of any one of embodiments 30 to 789, wherein ABM2 is an antibody, an antibody fragment, an scFv, a dsFv, a Fv, a Fab, an scFab, a (Fab')2, a single domain antibody (SDAB), a VH or VL domain, or a camelid VHH domain.

791. The CD2 binding molecule of embodiment 790, wherein ABM2 is an scFv.

792. The CD2 binding molecule of any of embodiment 790, wherein ABM2 is a Fab.

793. The CD2 binding molecule of embodiment 622, wherein if TAA is a receptor, ABM2 comprises a receptor binding domain of a ligand of the receptor, and if TAA is a ligand, ABM2 comprises a ligand binding domain of a receptor of the ligand.

794. The CD2 binding molecule of embodiment 793, wherein the TAA is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

795. The CD2 binding molecule of embodiment 794, wherein the TAA is CD22.

796. The CD2 binding molecule of embodiment 794, wherein the TAA is CS1.

797. The CD2 binding molecule of embodiment 794, wherein the TAA is CD33.

798. The CD2 binding molecule of embodiment 794, wherein the TAA is GD2.

799. The CD2 binding molecule of embodiment 794, wherein the TAA is BCMA.

800. The CD2 binding molecule of embodiment 794, wherein the TAA is Tn.

801. The CD2 binding molecule of embodiment 794, wherein the TAA is PSMA.

802. The CD2 binding molecule of embodiment 794, wherein the TAA is ROR1.

803. The CD2 binding molecule of embodiment 794, wherein the TAA is FLT3.

804. The CD2 binding molecule of embodiment 794, wherein the TAA is TAAG72.

805. The CD2 binding molecule of embodiment 794, wherein the TAA is FAP.

806. The CD2 binding molecule of embodiment 794, wherein the TAA is CD38.

807. The CD2 binding molecule of embodiment 794, wherein the TAA is CD44v6.

808. The CD2 binding molecule of embodiment 794, wherein the TAA is CEA.

809. The CD2 binding molecule of embodiment 794, wherein the TAA is EPCAM.

810. The CD2 binding molecule of embodiment 794, wherein the TAA is PRSS21.

811. The CD2 binding molecule of embodiment 794, wherein the TAA is B7H3.

812. The CD2 binding molecule of embodiment 794, wherein the TAA is KIT.

813. The CD2 binding molecule of embodiment 794, wherein the TAA is IL-13Ra2.

814. The CD2 binding molecule of embodiment 794, wherein the TAA is CD30.

815. The CD2 binding molecule of embodiment 794, wherein the TAA is GD3.

816. The CD2 binding molecule of embodiment 794, wherein the TAA is CD171.

817. The CD2 binding molecule of embodiment 794, wherein the TAA is IL-11Ra.

818. The CD2 binding molecule of embodiment 794, wherein the TAA is PSCA.

819. The CD2 binding molecule of embodiment 794, wherein the TAA is VEGFR2.

820. The CD2 binding molecule of embodiment 794, wherein the TAA is LewisY.

821. The CD2 binding molecule of embodiment 794, wherein the TAA is CD24.

822. The CD2 binding molecule of embodiment 794, wherein the TAA is PDGFR-beta.

823. The CD2 binding molecule of embodiment 794, wherein the TAA is SSEA-4.

824. The CD2 binding molecule of embodiment 794, wherein the TAA is CD20.

825. The CD2 binding molecule of embodiment 794, wherein the TAA is folate receptor alpha.

826. The CD2 binding molecule of embodiment 794, wherein the TAA is ERBB2.

827. The CD2 binding molecule of embodiment 794, wherein the TAA is MUC1.

828. The CD2 binding molecule of embodiment 794, wherein the TAA is EGFR.

829. The CD2 binding molecule of embodiment 794, wherein the TAA is NCAM.

830. The CD2 binding molecule of embodiment 794, wherein the TAA is ephrin B2

831. The CD2 binding molecule of embodiment 794, wherein the TAA is IGF-I receptor.

832. The CD2 binding molecule of embodiment 794, wherein the TAA is CAIX.

833. The CD2 binding molecule of embodiment 794, wherein the TAA is LMP2.

834. The CD2 binding molecule of embodiment 794, wherein the TAA is gp100.

835. The CD2 binding molecule of embodiment 794, wherein the TAA is tyrosinase.

836. The CD2 binding molecule of embodiment 794, wherein the TAA is ephA2.

837. The CD2 binding molecule of embodiment 794, wherein the TAA is mesothelin.

838. The CD2 binding molecule of embodiment 794, wherein the TAA is ALK.

839. The CD2 binding molecule of embodiment 794, wherein the TAA is CD19.

840. The CD2 binding molecule of embodiment 794, wherein the TAA is CD97.

841. The CD2 binding molecule of embodiment 794, wherein the TAA is CLDN6.

842. The CD2 binding molecule of embodiment 794, wherein the TAA is EGFRvIII.

843. The CD2 binding molecule of embodiment 794, wherein the TAA is folate receptor beta.

844. The CD2 binding molecule of embodiment 794, wherein the TAA is GloboH.

845. The CD2 binding molecule of embodiment 794, wherein the TAA is GPRC5D.

846. The CD2 binding molecule of embodiment 794, wherein the TAA is HMWMAA.

847. The CD2 binding molecule of embodiment 794, wherein the TAA is LRP6.

848. The CD2 binding molecule of embodiment 794, wherein the TAA is NY-BR-1.

849. The CD2 binding molecule of embodiment 794, wherein the TAA is PLAC1.

850. The CD2 binding molecule of embodiment 794, wherein the TAA is polysialic acid.

851. The CD2 binding molecule of embodiment 794, wherein the TAA is TEM1/CD248.

852. The CD2 binding molecule of embodiment 794, wherein the TAA is TSHR.

853. The CD2 binding molecule of embodiment 794, wherein the TAA is CD19.

854. The CD2 binding molecule of embodiment 794, wherein the TAA is Her2.

855. The CD2 binding molecule of any one of embodiments 30 to 854, which is a bispecific binding molecule (BBM).

856. The CD2 binding molecule of embodiment 855, which is bivalent.

857. The CD2 binding molecule of embodiment 856, wherein the CD2 binding molecule has any one of the configurations depicted in FIGS. 1B-1F with the variant CD58 domain substituted for a depicted Fab or scFv.

858. The CD2 binding molecule of embodiment 857, wherein the CD2 binding molecule has the configuration depicted in FIG. 1B with the variant CD58 domain substituted for a depicted Fab or scFv.

859. The CD2 binding molecule of embodiment 857, wherein the CD2 binding molecule has the configuration depicted in FIG. 1C with the variant CD58 domain substituted for a depicted Fab or scFv.

860. The CD2 binding molecule of embodiment 857, wherein the CD2 binding molecule has the configuration depicted in FIG. 1D with the variant CD58 domain substituted for a depicted Fab or scFv.

861. The CD2 binding molecule of embodiment 857, wherein the CD2 binding molecule has the configuration depicted in FIG. 1E with the variant CD58 domain substituted for a depicted Fab or scFv.

862. The CD2 binding molecule of embodiment 857, wherein the CD2 binding molecule has the configuration depicted in FIG. 1F with the variant CD58 domain substituted for a depicted Fab or scFv.

863. The CD2 binding molecule of any one of embodiments 857 to 862, which has the configuration referred to as B1 in Section 7.7.1.

864. The CD2 binding molecule of any one of embodiments 857 to 862, which has the configuration referred to as B2 in Section 7.7.1.

865. The CD2 binding molecule of embodiment 855, which is trivalent.

866. The CD2 binding molecule of embodiment 865, wherein the CD2 binding molecule has any one of the configurations depicted in (i) FIGS. 1G-1T with the variant CD58 domain substituted for at least one depicted Fab and/or scFv, (ii) FIGS. 1U-1W with the variant CD58 domain optionally substituted for at least one depicted Fab and/or scFv or (iii) FIGS. 1X-1Z with the variant CD58 domain substituted for at least one depicted Fab and/or scFv.

867. The CD2 binding molecule of embodiment 866, wherein the CD2 binding molecule has the configuration depicted in FIG. 1G with the variant CD58 domain substituted for at least one depicted Fab and/or scFv.

868. The CD2 binding molecule of embodiment 866, wherein the CD2 binding molecule has the configuration depicted in FIG. 1H with the variant CD58 domain substituted for at least one depicted Fab and/or scFv.

869. The CD2 binding molecule of embodiment 866, wherein the CD2 binding molecule has the configuration depicted in FIG. 1I with the variant CD58 domain substituted for at least one depicted Fab and/or scFv.

870. The CD2 binding molecule of embodiment 866, wherein the CD2 binding molecule has the configuration depicted in FIG. 1J with the variant CD58 domain substituted for at least one depicted Fab and/or scFv.

871. The CD2 binding molecule of embodiment 866, wherein the CD2 binding molecule has the configuration depicted in FIG. 1K with the variant CD58 domain substituted for at least one depicted Fab and/or scFv.

872. The CD2 binding molecule of embodiment 866, wherein the CD2 binding molecule has the configuration depicted in FIG. 1L with the variant CD58 domain substituted for at least one depicted Fab and/or scFv.

873. The CD2 binding molecule of embodiment 866, wherein the CD2 binding molecule has the configuration depicted in FIG. 1M with the variant CD58 domain substituted for at least one depicted Fab and/or scFv.

874. The CD2 binding molecule of embodiment 866, wherein the CD2 binding molecule has the configuration depicted in FIG. 1N with the variant CD58 domain substituted for at least one depicted Fab and/or scFv.

875. The CD2 binding molecule of embodiment 866, wherein the CD2 binding molecule has the configuration depicted in FIG. 1O with the variant CD58 domain substituted for at least one depicted Fab and/or scFv.

876. The CD2 binding molecule of embodiment 866, wherein the CD2 binding molecule has the configuration depicted in FIG. 1P with the variant CD58 domain substituted for at least one depicted Fab and/or scFv.

877. The CD2 binding molecule of embodiment 866, wherein the CD2 binding molecule has the configuration depicted in FIG. 1Q with the variant CD58 domain substituted for at least one depicted Fab and/or scFv.

878. The CD2 binding molecule of embodiment 866, wherein the CD2 binding molecule has the configuration depicted in FIG. 1R with the variant CD58 domain substituted for at least one depicted Fab and/or scFv.

879. The CD2 binding molecule of embodiment 866, wherein the CD2 binding molecule has the configuration depicted in FIG. 1S with the variant CD58 domain substituted for at least one depicted Fab and/or scFv.

880. The CD2 binding molecule of embodiment 866, wherein the CD2 binding molecule has the configuration depicted in FIG. 1T with the variant CD58 domain substituted for at least one depicted Fab and/or scFv.

881. The CD2 binding molecule of embodiment 866, wherein the CD2 binding molecule has the configuration depicted in FIG. 1U with the variant CD58 domain optionally substituted for at least one depicted Fab and/or scFv.

882. The CD2 binding molecule of embodiment 866, wherein the CD2 binding molecule has the configuration depicted in FIG. 1V with the variant CD58 domain optionally substituted for at least one depicted Fab and/or scFv.

883. The CD2 binding molecule of embodiment 866, wherein the CD2 binding molecule has the configuration depicted in FIG. 1W with the variant CD58 domain optionally substituted for at least one depicted Fab and/or scFv.

884. The CD2 binding molecule of embodiment 866, wherein the CD2 binding molecule has the configuration depicted in FIG. 1X with the variant CD58 domain substituted for at least one depicted Fab and/or scFv.

885. The CD2 binding molecule of embodiment 866, wherein the CD2 binding molecule has the configuration depicted in FIG. 1Y with the variant CD58 domain substituted for at least one depicted Fab and/or scFv.

886. The CD2 binding molecule of embodiment 866, wherein the CD2 binding molecule has the configuration depicted in FIG. 1Z with the variant CD58 domain substituted for at least one depicted Fab and/or scFv.

887. The CD2 binding molecule of any one of embodiments 865 to 886, which has the configuration referred to as T1 in Section 7.7.2.

888. The CD2 binding molecule of any one of embodiments 865 to 886, which has the configuration referred to as T2 in Section 7.7.2.

889. The CD2 binding molecule of any one of embodiments 865 to 886, which has the configuration referred to as T3 in Section 7.7.2.

890. The CD2 binding molecule of any one of embodiments 865 to 886, which has the configuration referred to as T4 in Section 7.7.2.

891. The CD2 binding molecule of any one of embodiments 865 to 886, which has the configuration referred to as T5 in Section 7.7.2.

892. The CD2 binding molecule of any one of embodiments 865 to 886, which has the configuration referred to as T6 in Section 7.7.2.

893. The CD2 binding molecule of embodiment 855, which is tetravalent.

894. The CD2 binding molecule of embodiment 893, wherein the CD2 binding molecule has any one of the configurations depicted in FIGS. 1AA-1AH with the variant CD58 domain substituted for at least one depicted Fab and/or scFv.

895. The CD2 binding molecule of embodiment 894, wherein the CD2 binding molecule has the configuration depicted in FIG. 1AA with the variant CD58 domain substituted for at least one depicted Fab and/or scFv.

896. The CD2 binding molecule of embodiment 894, wherein the CD2 binding molecule has the configuration depicted in FIG. 1AB with the variant CD58 domain substituted for at least one depicted Fab and/or scFv.

897. The CD2 binding molecule of embodiment 894, wherein the CD2 binding molecule has the configuration depicted in FIG. 1AC with the variant CD58 domain substituted for at least one depicted Fab and/or scFv.

898. The CD2 binding molecule of embodiment 894, wherein the CD2 binding molecule has the configuration depicted in FIG. 1AD with the variant CD58 domain substituted for at least one depicted Fab and/or scFv.

899. The CD2 binding molecule of embodiment 894, wherein the CD2 binding molecule has the configuration depicted in FIG. 1AE with the variant CD58 domain substituted for at least one depicted Fab and/or scFv.

900. The CD2 binding molecule of embodiment 894, wherein the CD2 binding molecule has the configuration depicted in FIG. 1AF with the variant CD58 domain substituted for at least one depicted Fab and/or scFv.

901. The CD2 binding molecule of embodiment 894, wherein the CD2 binding molecule has the configuration depicted in FIG. 1AG with the variant CD58 domain substituted for at least one depicted Fab and/or scFv.

902. The CD2 binding molecule of embodiment 894, wherein the CD2 binding molecule has the configuration depicted in FIG. 1AH with the variant CD58 domain substituted for at least one depicted Fab and/or scFv.

903. The CD2 binding molecule of any one of embodiments 893 to 902, which has the configuration referred to as Tv1 in Section 7.7.3.

904. The CD2 binding molecule of any one of embodiments 893 to 902, which has the configuration referred to as Tv2 in Section 7.7.3.

905. The CD2 binding molecule of any one of embodiments 893 to 902, which has the configuration referred to as Tv3 in Section 7.7.3.

906. The CD2 binding molecule of any one of embodiments 893 to 902, which has the configuration referred to as Tv4 in Section 7.7.3.

907. The CD2 binding molecule of any one of embodiments 893 to 902, which has the configuration referred to as Tv5 in Section 7.7.3.

908. The CD2 binding molecule of any one of embodiments 893 to 902, which has the configuration referred to as Tv6 in Section 7.7.3.

909. The CD2 binding molecule of any one of embodiments 893 to 902, which has the configuration referred to as Tv7 in Section 7.7.3.

910. The CD2 binding molecule of any one of embodiments 893 to 902, which has the configuration referred to as Tv8 in Section 7.7.3.

911. The CD2 binding molecule of any one of embodiments 893 to 902, which has the configuration referred to as Tv9 in Section 7.7.3.

912. The CD2 binding molecule of any one of embodiments 893 to 902, which has the configuration referred to as Tv10 in Section 7.7.3.

913. The CD2 binding molecule of any one of embodiments 893 to 902, which has the configuration referred to as Tv11 in Section 7.7.3.

914. The CD2 binding molecule of any one of embodiments 893 to 902, which has the configuration referred to as Tv12 in Section 7.7.3.

915. The CD2 binding molecule of any one of embodiments 893 to 902, which has the configuration referred to as Tv13 in Section 7.7.3.

916. The CD2 binding molecule of any one of embodiments 893 to 902, which has the configuration referred to as Tv14 in Section 7.7.3.

917. The CD2 binding molecule of any one of embodiments 30 to 854, which is a trispecific binding molecule (TBM) further comprising a third antigen-binding module (ABM3), optionally wherein ABM3 binds specifically to a human tumor-associated antigen (TAA).

918. The CD2 binding molecule of embodiment 917, wherein ABM3 binds specifically to a human TAA, and wherein when ABM2 binds to a TAA, ABM2 and ABM3 bind specifically to different TAAs.

919. The CD2 binding molecule of embodiment 918, wherein ABM3 is an anti-TAA antibody or an antigen-binding domain thereof.

920. The CD2 binding molecule of embodiment 919, wherein ABM3 binds specifically to a TAA which is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

921. The CD2 binding molecule of embodiment 920, wherein ABM3 is an anti-TAA antibody or antigen-binding domain thereof having the CDR sequences of an antibody set forth in Table 14A or Table 14B.

922. The CD2 binding molecule of embodiment 920, wherein ABM3 is an anti-TAA antibody or antigen-binding domain thereof has the heavy and light chain variable region sequences of an antibody set forth in Table 14A or Table 14B.

923. The CD2 binding molecule of embodiment 921 or embodiment 922, wherein ABM3 binds to CD22.

924. The CD2 binding molecule of embodiment 921 or embodiment 922, wherein ABM3 binds to CS1.

925. The CD2 binding molecule of embodiment 921 or embodiment 922, wherein ABM3 binds to CD33.

926. The CD2 binding molecule of embodiment 921 or embodiment 922, wherein ABM3 binds to GD2.

927. The CD2 binding molecule of embodiment 921 or embodiment 922, wherein ABM3 binds to BCMA.

928. The CD2 binding molecule of embodiment 921 or embodiment 922, wherein ABM3 binds to Tn.

929. The CD2 binding molecule of embodiment 921 or embodiment 922, wherein ABM3 binds to PSMA.

930. The CD2 binding molecule of embodiment 921 or embodiment 922, wherein ABM3 binds to ROR1.

931. The CD2 binding molecule of embodiment 921 or embodiment 922, wherein ABM3 binds to FLT3.

932. The CD2 binding molecule of embodiment 921 or embodiment 922, wherein ABM3 binds to TAAG72.

933. The CD2 binding molecule of embodiment 921 or embodiment 922, wherein ABM3 binds to FAP.

934. The CD2 binding molecule of embodiment 921 or embodiment 922, wherein ABM3 binds to CD38.

935. The CD2 binding molecule of embodiment 921 or embodiment 922, wherein ABM3 binds to CD44v6.

936. The CD2 binding molecule of embodiment 921 or embodiment 922, wherein ABM3 binds to CEA.

937. The CD2 binding molecule of embodiment 921 or embodiment 922, wherein ABM3 binds to EPCAM.

938. The CD2 binding molecule of embodiment 921 or embodiment 922, wherein ABM3 binds to PRSS21.

939. The CD2 binding molecule of embodiment 921 or embodiment 922, wherein ABM3 binds to B7H3.

940. The CD2 binding molecule of embodiment 921 or embodiment 922, wherein ABM3 binds to KIT.

941. The CD2 binding molecule of embodiment 921 or embodiment 922, wherein ABM3 binds to IL-13Ra2.

942. The CD2 binding molecule of embodiment 921 or embodiment 922, wherein ABM3 binds to CD30.

943. The CD2 binding molecule of embodiment 921 or embodiment 922, wherein ABM3 binds to GD3.

944. The CD2 binding molecule of embodiment 921 or embodiment 922, wherein ABM3 binds to CD171.

945. The CD2 binding molecule of embodiment 921 or embodiment 922, wherein ABM3 binds to IL-11Ra.

946. The CD2 binding molecule of embodiment 921 or embodiment 922, wherein ABM3 binds to PSCA.

947. The CD2 binding molecule of embodiment 921 or embodiment 922, wherein binds to VEGFR2.

948. The CD2 binding molecule of embodiment 921 or embodiment 922, wherein ABM3 binds to LewisY.

949. The CD2 binding molecule of embodiment 921 or embodiment 922, wherein ABM3 binds to CD24.

950. The CD2 binding molecule of embodiment 921 or embodiment 922, wherein ABM3 binds to PDGFR-beta.

951. The CD2 binding molecule of embodiment 921 or embodiment 922, wherein ABM3 binds to SSEA-4.

952. The CD2 binding molecule of embodiment 921 or embodiment 922, wherein ABM3 binds to CD20.

953. The CD2 binding molecule of embodiment 921 or embodiment 922, wherein binds to folate receptor alpha.

954. The CD2 binding molecule of embodiment 921 or embodiment 922, wherein ABM3 binds to ERBB2.

955. The CD2 binding molecule of embodiment 921 or embodiment 922, wherein ABM3 binds to MUC1.

956. The CD2 binding molecule of embodiment 921 or embodiment 922, wherein ABM3 binds to EGFR.

957. The CD2 binding molecule of embodiment 921 or embodiment 922, wherein ABM3 binds to NCAM.

958. The CD2 binding molecule of embodiment 921 or embodiment 922, wherein ABM3 binds to ephrin B2

959. The CD2 binding molecule of embodiment 921 or embodiment 922, wherein ABM3 binds to IGF-I receptor.

960. The CD2 binding molecule of embodiment 921 or embodiment 922, wherein ABM3 binds to CAIX.

961. The CD2 binding molecule of embodiment 921 or embodiment 922, wherein ABM3 binds to LMP2.

962. The CD2 binding molecule of embodiment 921 or embodiment 922, wherein ABM3 binds to gp100.

963. The CD2 binding molecule of embodiment 921 or embodiment 922, wherein ABM3 binds to tyrosinase.

964. The CD2 binding molecule of embodiment 921 or embodiment 922, wherein ABM3 binds to ephA2.

965. The CD2 binding molecule of embodiment 921 or embodiment 922, wherein ABM3 binds to mesothelin.

966. The CD2 binding molecule of embodiment 921 or embodiment 922, wherein ABM3 binds to ALK.

967. The CD2 binding molecule of embodiment 921 or embodiment 922, wherein ABM3 binds to CD19.

968. The CD2 binding molecule of embodiment 921 or embodiment 922, wherein ABM3 binds to CD97.

969. The CD2 binding molecule of embodiment 921 or embodiment 922, wherein ABM3 binds to CLDN6.

970. The CD2 binding molecule of embodiment 921 or embodiment 922, wherein ABM3 binds to EGFRvIII.

971. The CD2 binding molecule of embodiment 921 or embodiment 922, wherein ABM3 binds to folate receptor beta.

972. The CD2 binding molecule of embodiment 921 or embodiment 922, wherein ABM3 binds to GloboH.

973. The CD2 binding molecule of embodiment 921 or embodiment 922, wherein ABM3 binds to GPRC5D.

974. The CD2 binding molecule of embodiment 921 or embodiment 922, wherein ABM3 binds to HMWMAA.

975. The CD2 binding molecule of embodiment 921 or embodiment 922, wherein ABM3 binds to LRP6.

976. The CD2 binding molecule of embodiment 921 or embodiment 922, wherein ABM3 binds to NY-BR-1.

977. The CD2 binding molecule of embodiment 921 or embodiment 922, wherein ABM3 binds to PLAC1.

978. The CD2 binding molecule of embodiment 921 or embodiment 922, wherein ABM3 binds to polysialic acid.

979. The CD2 binding molecule of embodiment 921 or embodiment 922, wherein ABM3 binds to TEM1/CD248.

980. The CD2 binding molecule of embodiment 921 or embodiment 922, wherein ABM3 binds to TSHR.

981. The CD2 binding molecule of embodiment 919, wherein ABM3 binds to CD19.

982. The CD2 binding molecule of embodiment 981, wherein ABM3 comprises the CDR-H1, CDR-H2, CDR-H3, CDR-L1, CDR-L2, and CDR-L3 sequence of the anti-CD19 antibody NEG258 as defined by Kabat and set forth in Table 17A.

983. The CD2 binding molecule of embodiment 981, wherein ABM3 comprises the CDR-H1, CDR-H2, CDR-H3, CDR-L1, CDR-L2, and CDR-L3 sequences of the anti-CD19 antibody NEG258 as defined by Chothia and set forth in Table 17A.

984. The CD2 binding molecule of embodiment 981, wherein ABM3 comprises the CDR-H1, CDR-H2, CDR-H3, CDR-L1, CDR-L2, and CDR-L3 sequence of the anti-CD19 antibody NEG258 as defined by IMGT and set forth in Table 17A.

985. The CD2 binding molecule of embodiment 981, wherein ABM3 comprises the CDR-H1, CDR-H2, CDR-H3, CDR-L1, CDR-L2, and CDR-L3 sequences of the anti-CD19 antibody NEG258 as defined by the combination of Kabat and Chothia and set forth in Table 17A.

986. The CD2 binding molecule of embodiment 981, wherein ABM3 comprises the heavy chain and/or light chain variable sequences of the anti-CD19 antibody NEG258 as set forth in Table 17A.

987. The CD2 binding molecule of embodiment 981, wherein ABM3 comprises the CDR-H1, CDR-H2, CDR-H3, CDR-L1, CDR-L2, and CDR-L3 sequence of the anti-CD19 antibody NEG218 as defined by Kabat and set forth in Table 17B.

988. The CD2 binding molecule of embodiment 981, wherein ABM3 comprises the CDR-H1, CDR-H2, CDR-H3, CDR-L1, CDR-L2, and CDR-L3 sequences of the anti-CD19 antibody NEG218 as defined by Chothia and set forth in Table 17B.

989. The CD2 binding molecule of embodiment 981, wherein ABM3 comprises the CDR-H1, CDR-H2, CDR-H3, CDR-L1, CDR-L2, and CDR-L3 sequence of the anti-CD19 antibody NEG218 as defined by IMGT and set forth in Table 17B.

990. The CD2 binding molecule of embodiment 981, wherein ABM3 comprises the CDR-H1, CDR-H2, CDR-H3, CDR-L1, CDR-L2, and CDR-L3 sequences of the anti-CD19 antibody NEG218 as defined by the combination of Kabat and Chothia and set forth in Table 17B.

991. The CD2 binding molecule of embodiment 981, wherein ABM3 comprises the heavy chain and/or light chain variable sequences of the anti-CD19 antibody NEG218 as set forth in Table 17B.

992. The CD2 binding molecule of embodiment 981, wherein ABM3 comprises heavy chain CDRs having the amino acid sequences of CD19-H1, CD19-H2A, and CD19-H3 as set forth in Table 16 and light chain CDRs having the amino acid sequences of CD19-L1, CD19-L2, and CD19-L3 as set forth in Table 16.

993. The CD2 binding molecule of embodiment 981, wherein ABM3 comprises a heavy chain variable region having the amino acid sequences of VHA as set forth in Table 16 and a light chain variable region having the amino acid sequences of VLA as set forth in Table 16.

994. The CD2 binding molecule of embodiment 981, wherein ABM3 comprises heavy chain CDRs having the amino acid sequences of CD19-H1, CD19-H2B, and CD19-H3 as set forth in Table 16 and light chain CDRs having the amino acid sequences of CD19-L1, CD19-L2, and CD19-L3 as set forth in Table 16.

995. The CD2 binding molecule of embodiment 981, wherein ABM3 comprises a heavy chain variable region having the amino acid sequences of VHB as set forth in Table 16 and a light chain variable region having the amino acid sequences of VLB as set forth in Table 16.

996. The CD2 binding molecule of embodiment 981, wherein ABM3 comprises heavy chain CDRs having the amino acid sequences of CD19-H1, CD19-H2C, and CD19-H3 as set forth in Table 16 and light chain CDRs having the amino acid sequences of CD19-L1, CD19-L2, and CD19-L3 as set forth in Table 16.

997. The CD2 binding molecule of embodiment 981, wherein ABM3 comprises a heavy chain variable region having the amino acid sequences of VHC as set forth in Table 16 and a light chain variable region having the amino acid sequences of VLB as set forth in Table 16.

998. The CD2 binding molecule of embodiment 981, ABM3 comprises heavy chain CDRs having the amino acid sequences of CD19-H1, CD19-H2D, and CD19-H3 as set forth in Table 16 and light chain CDRs having the amino acid sequences of CD19-L1, CD19-L2, and CD19-L3 as set forth in Table 16.

999. The CD2 binding molecule of embodiment 981, wherein ABM3 comprises a heavy chain variable region having the amino acid sequences of VHD as set forth in Table 16 and a light chain variable region having the amino acid sequences of VLB as set forth in Table 16.

1000. The CD2 binding molecule of embodiment 919, wherein ABM3 binds to Her2.

1001. The CD2 binding molecule of embodiment 919, wherein ABM3 binds to mesothelin.

1002. The CD2 binding molecule of embodiment 919, wherein ABM3 binds to BCMA.

1003. The CD2 binding molecule of embodiment 1002, wherein ABM3 comprises the CDR sequences of BCMA-1.

1004. The CD2 binding molecule of embodiment 1002, wherein ABM3 comprises the CDR sequences of BCMA-2.

1005. The CD2 binding molecule of embodiment 1002, wherein ABM3 comprises the CDR sequences of BCMA-3.

1006. The CD2 binding molecule of embodiment 1002, wherein ABM3 comprises the CDR sequences of BCMA-4.

1007. The CD2 binding molecule of embodiment 1002, wherein ABM3 comprises the CDR sequences of BCMA-5.

1008. The CD2 binding molecule of embodiment 1002, wherein ABM3 comprises the CDR sequences of BCMA-6.

1009. The CD2 binding molecule of embodiment 1002, wherein ABM3 comprises the CDR sequences of BCMA-7.

1010. The CD2 binding molecule of embodiment 1002, wherein ABM3 comprises the CDR sequences of BCMA-8.

1011. The CD2 binding molecule of embodiment 1002, wherein ABM3 comprises the CDR sequences of BCMA-9.

1012. The CD2 binding molecule of embodiment 1002, wherein ABM3 comprises the CDR sequences of BCMA-10.

1013. The CD2 binding molecule of embodiment 1002, wherein ABM3 comprises the CDR sequences of BCMA-11.

1014. The CD2 binding molecule of embodiment 1002, wherein ABM3 comprises the CDR sequences of BCMA-12.

1015. The CD2 binding molecule of embodiment 1002, wherein ABM3 comprises the CDR sequences of BCMA-13.

1016. The CD2 binding molecule of embodiment 1002, wherein ABM3 comprises the CDR sequences of BCMA-14.

1017. The CD2 binding molecule of embodiment 1002, wherein ABM3 comprises the CDR sequences of BCMA-15.

1018. The CD2 binding molecule of embodiment 1002, wherein ABM3 comprises the CDR sequences of BCMA-16.

1019. The CD2 binding molecule of embodiment 1002, wherein ABM3 comprises the CDR sequences of BCMA-17.

1020. The CD2 binding molecule of embodiment 1002, wherein ABM3 comprises the CDR sequences of BCMA-18.

1021. The CD2 binding molecule of embodiment 1002, wherein ABM3 comprises the CDR sequences of BCMA-19.

1022. The CD2 binding molecule of embodiment 1002, wherein ABM3 comprises the CDR sequences of BCMA-20.

1023. The CD2 binding molecule of embodiment 1002, wherein ABM3 comprises the CDR sequences of BCMA-21.

1024. The CD2 binding molecule of embodiment 1002, wherein ABM3 comprises the CDR sequences of BCMA-22.

1025. The CD2 binding molecule of embodiment 1002, wherein ABM3 comprises the CDR sequences of BCMA-23.

1026. The CD2 binding molecule of embodiment 1002, wherein ABM3 comprises the CDR sequences of BCMA-24.

1027. The CD2 binding molecule of embodiment 1002, wherein ABM3 comprises the CDR sequences of BCMA-25.

1028. The CD2 binding molecule of embodiment 1002, wherein ABM3 comprises the CDR sequences of BCMA-26.

1029. The CD2 binding molecule of embodiment 1002, wherein ABM3 comprises the CDR sequences of BCMA-27.

1030. The CD2 binding molecule of embodiment 1002, wherein ABM3 comprises the CDR sequences of BCMA-28.

1031. The CD2 binding molecule of embodiment 1002, wherein ABM3 comprises the CDR sequences of BCMA-29.

1032. The CD2 binding molecule of embodiment 1002, wherein ABM3 comprises the CDR sequences of BCMA-30.

1033. The CD2 binding molecule of embodiment 1002, wherein ABM3 comprises the CDR sequences of BCMA-31.

1034. The CD2 binding molecule of embodiment 1002, wherein ABM3 comprises the CDR sequences of BCMA-32.

1035. The CD2 binding molecule of embodiment 1002, wherein ABM3 comprises the CDR sequences of BCMA-33.

1036. The CD2 binding molecule of embodiment 1002, wherein ABM3 comprises the CDR sequences of BCMA-34.

1037. The CD2 binding molecule of embodiment 1002, wherein ABM3 comprises the CDR sequences of BCMA-35.

1038. The CD2 binding molecule of embodiment 1002, wherein ABM3 comprises the CDR sequences of BCMA-36.

1039. The CD2 binding molecule of embodiment 1002, wherein ABM3 comprises the CDR sequences of BCMA-37.

1040. The CD2 binding molecule of embodiment 1002, wherein ABM3 comprises the CDR sequences of BCMA-38.

1041. The CD2 binding molecule of embodiment 1002, wherein ABM3 comprises the CDR sequences of BCMA-39.

1042. The CD2 binding molecule of embodiment 1002, wherein ABM3 comprises the CDR sequences of BCMA-40.

1043. The CD2 binding molecule of any one of embodiments 1003 to 1042, wherein the CDRs are defined by Kabat numbering, as set forth in Tables 15B and 15E.

1044. The CD2 binding molecule of any one of embodiments 1003 to 1042, wherein the CDRs are defined by Chothia numbering, as set forth in Tables 15C and 15F.

1045. CD2 binding molecule of any one of embodiments 1003 to 1042, wherein the CDRs are defined by a combination of Kabat and Chothia numbering, as set forth in Tables 15D and 15G.

1046. The CD2 binding molecule of embodiment 1002, wherein ABM3 comprises the heavy and light chain variable sequences of BCMA-1, as set forth in Table 15A.

1047. The CD2 binding molecule of embodiment 1002, wherein ABM3 comprises the heavy and light chain variable sequences of BCMA-2, as set forth in Table 15A.

1048. The CD2 binding molecule of embodiment 1002, wherein ABM3 comprises the heavy and light chain variable sequences of BCMA-3, as set forth in Table 15A.

1049. The CD2 binding molecule of embodiment 1002, wherein ABM3 comprises the heavy and light chain variable sequences of BCMA-4, as set forth in Table 15A.

1050. The CD2 binding molecule of embodiment 1002, wherein ABM3 comprises the heavy and light chain variable sequences of BCMA-5, as set forth in Table 15A.

1051. The CD2 binding molecule of embodiment 1002, wherein ABM3 comprises the heavy and light chain variable sequences of BCMA-6, as set forth in Table 15A.

1052. The CD2 binding molecule of embodiment 1002, wherein ABM3 comprises the heavy and light chain variable sequences of BCMA-7, as set forth in Table 15A.

1053. The CD2 binding molecule of embodiment 1002, wherein ABM3 comprises the heavy and light chain variable sequences of BCMA-8, as set forth in Table 15A.

1054. The CD2 binding molecule of embodiment 1002, wherein ABM3 comprises the heavy and light chain variable sequences of BCMA-9, as set forth in Table 15A.

1055. The CD2 binding molecule of embodiment 1002, wherein ABM3 comprises the heavy and light chain variable sequences of BCMA-10, as set forth in Table 15A.

1056. The CD2 binding molecule of embodiment 1002, wherein ABM3 comprises the heavy and light chain variable sequences of BCMA-11, as set forth in Table 15A.

1057. The CD2 binding molecule of embodiment 1002, wherein ABM3 comprises the heavy and light chain variable sequences of BCMA-12, as set forth in Table 15A.

1058. The CD2 binding molecule of embodiment 1002, wherein ABM3 comprises the heavy and light chain variable sequences of BCMA-13, as set forth in Table 15A.

1059. The CD2 binding molecule of embodiment 1002, wherein ABM3 comprises the heavy and light chain variable sequences of BCMA-14, as set forth in Table 15A.

1060. The CD2 binding molecule of embodiment 1002, wherein ABM3 comprises the heavy and light chain variable sequences of BCMA-15, as set forth in Table 15A.

1061. The CD2 binding molecule of embodiment 1002, wherein ABM3 comprises the heavy and light chain variable sequences of BCMA-16, as set forth in Table 15A.

1062. The CD2 binding molecule of embodiment 1002, wherein ABM3 comprises the heavy and light chain variable sequences of BCMA-17, as set forth in Table 15A.

1063. The CD2 binding molecule of embodiment 1002, wherein ABM3 comprises the heavy and light chain variable sequences of BCMA-18, as set forth in Table 15A.

1064. The CD2 binding molecule of embodiment 1002, wherein ABM3 comprises the heavy and light chain variable sequences of BCMA-19, as set forth in Table 15A.

1065. The CD2 binding molecule of embodiment 1002, wherein ABM3 comprises the heavy and light chain variable sequences of BCMA-20, as set forth in Table 15A.

1066. The CD2 binding molecule of embodiment 1002, wherein ABM3 comprises the heavy and light chain variable sequences of BCMA-21, as set forth in Table 15A.

1067. The CD2 binding molecule of embodiment 1002, wherein ABM3 comprises the heavy and light chain variable sequences of BCMA-22, as set forth in Table 15A.

1068. The CD2 binding molecule of embodiment 1002, wherein ABM3 comprises the heavy and light chain variable sequences of BCMA-23, as set forth in Table 15A.

1069. The CD2 binding molecule of embodiment 1002, wherein ABM3 comprises the heavy and light chain variable sequences of BCMA-24, as set forth in Table 15A.

1070. The CD2 binding molecule of embodiment 1002, wherein ABM3 comprises the heavy and light chain variable sequences of BCMA-25, as set forth in Table 15A.

1071. The CD2 binding molecule of embodiment 1002, wherein ABM3 comprises the heavy and light chain variable sequences of BCMA-26, as set forth in Table 15A.

1072. The CD2 binding molecule of embodiment 1002, wherein ABM3 comprises the heavy and light chain variable sequences of BCMA-27, as set forth in Table 15A.

1073. The CD2 binding molecule of embodiment 1002, wherein ABM3 comprises the heavy and light chain variable sequences of BCMA-28, as set forth in Table 15A.

1074. The CD2 binding molecule of embodiment 1002, wherein ABM3 comprises the heavy and light chain variable sequences of BCMA-29, as set forth in Table 15A.

1075. The CD2 binding molecule of embodiment 1002, wherein ABM3 comprises the heavy and light chain variable sequences of BCMA-30, as set forth in Table 15A.

1076. The CD2 binding molecule of embodiment 1002, wherein ABM3 comprises the heavy and light chain variable sequences of BCMA-31, as set forth in Table 15A.

1077. The CD2 binding molecule of embodiment 1002, wherein ABM3 comprises the heavy and light chain variable sequences of BCMA-32, as set forth in Table 15A.

1078. The CD2 binding molecule of embodiment 1002, wherein ABM3 comprises the heavy and light chain variable sequences of BCMA-33, as set forth in Table 15A.

1079. The CD2 binding molecule of embodiment 1002, wherein ABM3 comprises the heavy and light chain variable sequences of BCMA-34, as set forth in Table 15A.

1080. The CD2 binding molecule of embodiment 1002, wherein ABM3 comprises the heavy and light chain variable sequences of BCMA-35, as set forth in Table 15A.

1081. The CD2 binding molecule of embodiment 1002, wherein ABM3 comprises the heavy and light chain variable sequences of BCMA-36, as set forth in Table 15A.

1082. The CD2 binding molecule of embodiment 1002, wherein ABM3 comprises the heavy and light chain variable sequences of BCMA-37, as set forth in Table 15A.

1083. The CD2 binding molecule of embodiment 1002, wherein ABM3 comprises the heavy and light chain variable sequences of BCMA-38, as set forth in Table 15A.

1084. The CD2 binding molecule of embodiment 1002, wherein ABM3 comprises the heavy and light chain variable sequences of BCMA-39, as set forth in Table 15A.

1085. The CD2 binding molecule of embodiment 1002, wherein ABM3 comprises the heavy and light chain variable sequences of BCMA-40, as set forth in Table 15A.

1086. The CD2 binding molecule of embodiment 1002, wherein ABM3 comprises the heavy and light chain variable sequences of BCMA-40, as set forth in Table 15A.

1087. The CD2 binding molecule of embodiment 918, wherein if ABM3 binds a TAA that is a receptor, ABM3 comprises a receptor binding domain of a ligand of the receptor, and if ABM3 binds a TAA that is a ligand, ABM3 comprises a ligand binding domain of a receptor of the ligand.

1088. The CD2 binding molecule of embodiment 1087, wherein ABM3 binds a TAA which is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TM-PRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

1089. The CD2 binding molecule of embodiment 1088, wherein ABM3 binds CD22.

1090. The CD2 binding molecule of embodiment 1088, wherein ABM3 binds CS1.

1091. The CD2 binding molecule of embodiment 1088, wherein ABM3 binds CD33.

1092. The CD2 binding molecule of embodiment 1088, wherein ABM3 binds GD2.

1093. The CD2 binding molecule of embodiment 1088, wherein ABM3 binds BCMA.

1094. The CD2 binding molecule of embodiment 1088, wherein ABM3 binds Tn.

1095. The CD2 binding molecule of embodiment 1088, wherein ABM3 binds PSMA.

1096. The CD2 binding molecule of embodiment 1088, wherein ABM3 binds ROR1.

1097. The CD2 binding molecule of embodiment 1088, wherein ABM3 binds FLT3.

1098. The CD2 binding molecule of embodiment 1088, wherein ABM3 binds TAAG72.

1099. The CD2 binding molecule of embodiment 1088, wherein ABM3 binds FAP.

1100. The CD2 binding molecule of embodiment 1088, wherein ABM3 binds CD38.

1101. The CD2 binding molecule of embodiment 1088, wherein ABM3 binds CD44v6.

1102. The CD2 binding molecule of embodiment 1088, wherein ABM3 binds CEA.

1103. The CD2 binding molecule of embodiment 1088, wherein ABM3 binds EPCAM.

1104. The CD2 binding molecule of embodiment 1088, wherein ABM3 binds PRSS21.

1105. The CD2 binding molecule of embodiment 1088, wherein ABM3 binds B7H3.

1106. The CD2 binding molecule of embodiment 1088, wherein ABM3 binds KIT.

1107. The CD2 binding molecule of embodiment 1088, wherein ABM3 binds IL-13Ra2.

1108. The CD2 binding molecule of embodiment 1088, wherein ABM3 binds CD30.

1109. The CD2 binding molecule of embodiment 1088, wherein ABM3 binds GD3.

1110. The CD2 binding molecule of embodiment 1088, wherein ABM3 binds CD171.

1111. The CD2 binding molecule of embodiment 1088, wherein ABM3 binds IL-11Ra.

1112. The CD2 binding molecule of embodiment 1088, wherein ABM3 binds PSCA.

1113. The CD2 binding molecule of embodiment 1088, wherein ABM3 binds VEGFR2.

1114. The CD2 binding molecule of embodiment 1088, wherein ABM3 binds LewisY.

1115. The CD2 binding molecule of embodiment 1088, wherein ABM3 binds CD24.

1116. The CD2 binding molecule of embodiment 1088, wherein ABM3 binds PDGFR-beta.

1117. The CD2 binding molecule of embodiment 1088, wherein ABM3 binds SSEA-4.

1118. The CD2 binding molecule of embodiment 1088, wherein ABM3 binds CD20.

1119. The CD2 binding molecule of embodiment 1088, wherein ABM3 binds folate receptor alpha.

1120. The CD2 binding molecule of embodiment 1088, wherein ABM3 binds ERBB2.

1121. The CD2 binding molecule of embodiment 1088, wherein the ABM3 binds MUC1.

1122. The CD2 binding molecule of embodiment 1088, wherein the ABM3 binds EGFR.

1123. The CD2 binding molecule of embodiment 1088, wherein the ABM3 binds NCAM.

1124. The CD2 binding molecule of embodiment 1088, wherein the ABM3 binds ephrin B2

1125. The CD2 binding molecule of embodiment 1088, wherein the ABM3 binds IGF-I receptor.

1126. The CD2 binding molecule of embodiment 1088, wherein the ABM3 binds CAIX.

1127. The CD2 binding molecule of embodiment 1088, wherein the ABM3 binds LMP2.

1128. The CD2 binding molecule of embodiment 1088, wherein the ABM3 binds gp100.

1129. The CD2 binding molecule of embodiment 1088, wherein the ABM3 binds tyrosinase.

1130. The CD2 binding molecule of embodiment 1088, wherein the ABM3 binds ephA2.

1131. The CD2 binding molecule of embodiment 1088, wherein the ABM3 binds mesothelin.

1132. The CD2 binding molecule of embodiment 1088, wherein the ABM3 binds ALK.

1133. The CD2 binding molecule of embodiment 1088, wherein the ABM3 binds CD19.

1134. The CD2 binding molecule of embodiment 1088, wherein the ABM3 binds CD97.

1135. The CD2 binding molecule of embodiment 1088, wherein the ABM3 binds CLDN6.

1136. The CD2 binding molecule of embodiment 1088, wherein the ABM3 binds EGFRvIII.

1137. The CD2 binding molecule of embodiment 1088, wherein the ABM3 binds folate receptor beta.

1138. The CD2 binding molecule of embodiment 1088, wherein the ABM3 binds GloboH.

1139. The CD2 binding molecule of embodiment 1088, wherein the ABM3 binds GPRC5D.

1140. The CD2 binding molecule of embodiment 1088, wherein the ABM3 binds HMWMAA.

1141. The CD2 binding molecule of embodiment 1088, wherein the ABM3 binds LRP6.

1142. The CD2 binding molecule of embodiment 1088, wherein the ABM3 binds NY-BR-1.

1143. The CD2 binding molecule of embodiment 1088, wherein the ABM3 binds PLAC1.

1144. The CD2 binding molecule of embodiment 1088, wherein the ABM3 binds polysialic acid.

1145. The CD2 binding molecule of embodiment 1088, wherein the ABM3 binds TEM1/CD248.

1146. The CD2 binding molecule of embodiment 1088, wherein the ABM3 binds TSHR.

1147. The CD2 binding molecule of embodiment 1088, wherein the ABM3 binds CD19.

1148. The CD2 binding molecule of embodiment 1088, wherein the TAA is Her2.

1149. The CD2 binding molecule of any one of embodiments 917 to 1148, which is trivalent.

1150. The CD2 binding molecule of embodiment 1149, wherein the CD2 binding molecule has any one of the configurations depicted in (i) FIGS. 2B-2G with the variant CD58 domain substituted for a depicted Fab or scFv, (ii) FIGS. 2H-2J with the variant CD58 domain optionally substituted for a depicted Fab or scFv, (iii) FIGS. 2K-2O with the variant CD58 domain substituted for a depicted Fab or scFv, or (iv) FIG. 2P with the variant CD58 domain optionally substituted for a depicted Fab or scFv.

1151. The CD2 binding molecule of embodiment 1150, wherein the CD2 binding molecule has the configuration depicted in FIG. 2B with the variant CD58 domain substituted for a depicted Fab or scFv.

1152. The CD2 binding molecule of embodiment 1150, wherein the CD2 binding molecule has the configuration depicted in FIG. 2C with the variant CD58 domain substituted for a depicted Fab or scFv.

1153. The CD2 binding molecule of embodiment 1150, wherein the CD2 binding molecule has the configuration depicted in FIG. 2D with the variant CD58 domain substituted for a depicted Fab or scFv.

1154. The CD2 binding molecule of embodiment 1150, wherein the CD2 binding molecule has the configuration depicted in FIG. 2E with the variant CD58 domain substituted for a depicted Fab or scFv.

1155. The CD2 binding molecule of embodiment 1150, wherein the CD2 binding molecule has the configuration depicted in FIG. 2F with the variant CD58 domain substituted for a depicted Fab or scFv.

1156. The CD2 binding molecule of embodiment 1150, wherein the CD2 binding molecule has the configuration depicted in FIG. 2G with the variant CD58 domain substituted for a depicted Fab or scFv.

1157. The CD2 binding molecule of embodiment 1150, wherein the CD2 binding molecule has the configuration depicted in FIG. 2H with the variant CD58 domain optionally substituted for a depicted Fab or scFv.

1158. The CD2 binding molecule of embodiment 1150, wherein the CD2 binding molecule has the configuration depicted in FIG. 2I with the variant CD58 domain optionally substituted for a depicted Fab or scFv.

1159. The CD2 binding molecule of embodiment 1150, wherein the CD2 binding molecule has the configuration depicted in FIG. 2J with the variant CD58 domain optionally substituted for a depicted Fab or scFv.

1160. The CD2 binding molecule of embodiment 1150, wherein the CD2 binding molecule has the configuration depicted in FIG. 2K with the variant CD58 domain substituted for a depicted Fab or scFv.

1161. The CD2 binding molecule of embodiment 1150, wherein the CD2 binding molecule has the configuration depicted in FIG. 2L with the variant CD58 domain substituted for a depicted Fab or scFv.

1162. The CD2 binding molecule of embodiment 1150, wherein the CD2 binding molecule has the configuration depicted in FIG. 2M with the variant CD58 domain substituted for a depicted Fab or scFv.

1163. The CD2 binding molecule of embodiment 1150, wherein the CD2 binding molecule has the configuration depicted in FIG. 2N with the variant CD58 domain substituted for a depicted Fab or scFv.

1164. The CD2 binding molecule of embodiment 1150, wherein the CD2 binding molecule has the configuration depicted in FIG. 2O with the variant CD58 domain substituted for a depicted Fab or scFv.

1165. The CD2 binding molecule of embodiment 1150, wherein the CD2 binding molecule has the configuration depicted in FIG. 2P with the variant CD58 domain optionally substituted for a depicted Fab or scFv.

1166. The CD2 binding molecule of any one of embodiments 1149 to 1165, which has the configuration referred to as T1 in Section 7.8.1.

1167. The CD2 binding molecule of any one of embodiments 1149 to 1165, which has the configuration referred to as T2 in Section 7.8.1.

1168. The CD2 binding molecule of any one of embodiments 1149 to 1165, which has the configuration referred to as T3 in Section 7.8.1.

1169. The CD2 binding molecule of any one of embodiments 1149 to 1165, which has the configuration referred to as T4 in Section 7.8.1.

1170. The CD2 binding molecule of any one of embodiments 1149 to 1165, which has the configuration referred to as T5 in Section 7.8.1.

1171. The CD2 binding molecule of any one of embodiments 1149 to 1165, which has the configuration referred to as T6 in Section 7.8.1.

1172. The CD2 binding molecule of any one of embodiments 917 to 1148, which is tetravalent.

1173. The CD2 binding molecule of embodiment 1172, wherein the CD2 binding molecule has any one of the configurations depicted in FIGS. 2Q-2S with the variant CD58 domain substituted for at least one depicted Fab and/or scFv.

1174. The CD2 binding molecule of embodiment 1173, wherein the CD2 binding molecule has the configuration depicted in FIG. 2Q with the variant CD58 domain substituted for at least one depicted Fab and/or scFv.

1175. The CD2 binding molecule of embodiment 1173, wherein the CD2 binding molecule has the configuration depicted in FIG. 2R with the variant CD58 domain substituted for at least one depicted Fab and/or scFv.

1176. The CD2 binding molecule of embodiment 1173, wherein the CD2 binding molecule has the configuration depicted in FIG. 2S with the variant CD58 domain substituted for at least one depicted Fab and/or scFv.

1177. The CD2 binding molecule of any one of embodiments 1172 to 1176, which has any of the configurations referred to as Tv1 through Tv24 in Table 9.

1178. The CD2 binding molecule of any one of embodiments 917 to 1148, which is pentavalent.

1179. The CD2 binding molecule of embodiment 1178, wherein the CD2 binding molecule has the configuration depicted in FIG. 2T with the variant CD58 domain substituted for at least one depicted Fab and/or scFv.

1180. The CD2 binding molecule of embodiment 1178 or embodiment 1179, which has any of the configurations referred to as Pv1 through Pv100 in Table 10.

1181. The CD2 binding molecule of any one of embodiments 917 to 1148, which is hexavalent.

1182. The CD2 binding molecule of embodiment 1181, wherein the CD2 binding molecule has any one of the configurations depicted in FIGS. 2U-2V with the variant CD58 domain substituted for at least one depicted Fab and/or scFv.

1183. The CD2 binding molecule of embodiment 1182, wherein the CD2 binding molecule has the configuration depicted in FIG. 2U with the variant CD58 domain substituted for at least one depicted Fab and/or scFv.

1184. The CD2 binding molecule of embodiment 1182, wherein the CD2 binding molecule has the configuration depicted in FIG. 2V with the variant CD58 domain substituted for at least one depicted Fab and/or scFv.

1185. The CD2 binding molecule of any one of embodiments 1181 to 1184, which has any of the configurations referred to as Hv1 through Hv330 in Table 11.

1186. The CD2 binding molecule of any one of embodiments 917 to 1182, except when depending from any one of embodiments 1087 to 1148, wherein ABM3 is an antibody, an antibody fragment, an scFv, a dsFv, a Fv, a Fab, an scFab, a (Fab')2, a single domain antibody (SDAB), a VH or VL domain, or a camelid VHH domain.

1187. The CD2 binding molecule of embodiment 1186, wherein ABM3 is an scFv.

1188. The CD2 binding molecule of embodiment 1187, wherein ABM3 binds CD19 and comprises the amino acid sequence of CD19-scFv1 as set forth in Table 16.

1189. The CD2 binding molecule of embodiment 1187 wherein ABM3 binds CD19 and comprises the amino acid sequence of CD19-scFv2 as set forth in Table 16.

1190. The CD2 binding molecule of embodiment 1187, wherein ABM3 binds CD19 and comprises the amino acid sequence of CD19-scFv3 as set forth in Table 16.

1191. The CD2 binding molecule of embodiment 1187, wherein ABM3 binds CD19 and comprises the amino acid sequence of CD19-scFv4 as set forth in Table 16.

1192. The CD2 binding molecule of embodiment 1187, wherein ABM3 binds CD19 and comprises the amino acid sequence of CD19-scFv5 as set forth in Table 16.

1193. The CD2 binding molecule of embodiment 1187, wherein ABM3 binds CD19 and comprises the amino acid sequence of CD19-scFv6 as set forth in Table 16.

1194. The CD2 binding molecule of embodiment 1187, wherein ABM3 binds CD19 and comprises the amino acid sequence of CD19-scFv7 as set forth in Table 16.

1195. The CD2 binding molecule of embodiment 1187, wherein ABM3 binds CD19 and comprises the amino acid sequence of CD19-scFv8 as set forth in Table 16.

1196. The CD2 binding molecule of embodiment 1187, wherein ABM3 binds CD19 and comprises the amino acid sequence of CD19-scFv9 as set forth in Table 16.

1197. The CD2 binding molecule of embodiment 1187, wherein ABM3 binds CD19 and comprises the amino acid sequence of CD19-scFv10 as set forth in Table 16.

1198. The CD2 binding molecule of embodiment 1187, wherein ABM3 binds CD19 and comprises the amino acid sequence of CD19-scFv11 as set forth in Table 16.

1199. The CD2 binding molecule of embodiment 1187, wherein ABM3 binds CD19 and comprises the amino acid sequence of CD19-scFv12 as set forth in Table 16.

1200. The CD2 binding molecule of embodiment 1187, wherein ABM3 binds BCMA and comprises the amino acid sequence of the scFv corresponding to BCMA-1 as set forth in Table 15A.

1201. The CD2 binding molecule of embodiment 1187, wherein ABM3 binds BCMA and comprises the amino acid sequence of the scFv corresponding to BCMA-2 as set forth in Table 15A.

1202. The CD2 binding molecule of embodiment 1187, wherein ABM3 binds BCMA and comprises the amino acid sequence of the scFv corresponding to BCMA-3 as set forth in Table 15A.

1203. The CD2 binding molecule of embodiment 1187, wherein ABM3 binds BCMA and comprises the amino acid sequence of the scFv corresponding to BCMA-4 as set forth in Table 15A.

1204. The CD2 binding molecule of embodiment 1187, wherein ABM3 binds BCMA and comprises the amino acid sequence of the scFv corresponding to BCMA-5 as set forth in Table 15A.

1205. The CD2 binding molecule of embodiment 1187, wherein ABM3 binds BCMA and comprises the amino acid sequence of the scFv corresponding to BCMA-6 as set forth in Table 15A.

1206. The CD2 binding molecule of embodiment 1187, wherein ABM3 binds BCMA and comprises the amino acid sequence of the scFv corresponding to BCMA-7 as set forth in Table 15A.

1207. The CD2 binding molecule of embodiment 1187, wherein ABM3 binds BCMA and comprises the amino acid sequence of the scFv corresponding to BCMA-8 as set forth in Table 15A.

1208. The CD2 binding molecule of embodiment 1187, wherein ABM3 binds BCMA and comprises the amino acid sequence of the scFv corresponding to BCMA-9 as set forth in Table 15A.

1209. The CD2 binding molecule of embodiment 1187, wherein ABM3 binds BCMA and comprises the amino acid sequence of the scFv corresponding to BCMA-10 as set forth in Table 15A.

1210. The CD2 binding molecule of embodiment 1187, wherein ABM3 binds BCMA and comprises the amino acid sequence of the scFv corresponding to BCMA-11 as set forth in Table 15A.

1211. The CD2 binding molecule of embodiment 1187, wherein ABM3 binds BCMA and comprises the amino acid sequence of the scFv corresponding to BCMA-12 as set forth in Table 15A.

1212. The CD2 binding molecule of embodiment 1187, wherein ABM3 binds BCMA and comprises the amino acid sequence of the scFv corresponding to BCMA-13 as set forth in Table 15A.

1213. The CD2 binding molecule of embodiment 1187, wherein ABM3 binds BCMA and comprises the amino acid sequence of the scFv corresponding to BCMA-14 as set forth in Table 15A.

1214. The CD2 binding molecule of embodiment 1187, wherein ABM3 binds BCMA and comprises the amino acid sequence of the scFv corresponding to BCMA-15 as set forth in Table 15A.

1215. The CD2 binding molecule of embodiment 1187, wherein ABM3 binds BCMA and comprises the amino acid sequence of the scFv corresponding to BCMA-16 as set forth in Table 15A.

1216. The CD2 binding molecule of embodiment 1187, wherein ABM3 binds BCMA and comprises the amino acid sequence of the scFv corresponding to BCMA-17 as set forth in Table 15A.

1217. The CD2 binding molecule of embodiment 1187, wherein ABM3 binds BCMA and comprises the amino acid sequence of the scFv corresponding to BCMA-18 as set forth in Table 15A.

1218. The CD2 binding molecule of embodiment 1187, wherein ABM3 binds BCMA and comprises the amino acid sequence of the scFv corresponding to BCMA-19 as set forth in Table 15A.

1219. The CD2 binding molecule of embodiment 1187, wherein ABM3 binds BCMA and comprises the amino acid sequence of the scFv corresponding to BCMA-20 as set forth in Table 15A.

1220. The CD2 binding molecule of embodiment 1187, wherein ABM3 binds BCMA and comprises the amino acid sequence of the scFv corresponding to BCMA-21 as set forth in Table 15A.

1221. The CD2 binding molecule of embodiment 1187, wherein ABM3 binds BCMA and comprises the amino acid sequence of the scFv corresponding to BCMA-22 as set forth in Table 15A.

1222. The CD2 binding molecule of embodiment 1187, wherein ABM3 binds BCMA and comprises the amino acid sequence of the scFv corresponding to BCMA-23 as set forth in Table 15A.

1223. The CD2 binding molecule of embodiment 1187, wherein ABM3 binds BCMA and comprises the amino acid sequence of the scFv corresponding to BCMA-24 as set forth in Table 15A.

1224. The CD2 binding molecule of embodiment 1187, wherein ABM3 binds BCMA and comprises the amino acid sequence of the scFv corresponding to BCMA-25 as set forth in Table 15A.

1225. The CD2 binding molecule of embodiment 1187, wherein ABM3 binds BCMA and comprises the amino acid sequence of the scFv corresponding to BCMA-26 as set forth in Table 15A.

1226. The CD2 binding molecule of embodiment 1187, wherein ABM3 binds BCMA and comprises the amino acid sequence of the scFv corresponding to BCMA-27 as set forth in Table 15A.

1227. The CD2 binding molecule of embodiment 1187, wherein ABM3 binds BCMA and comprises the amino acid sequence of the scFv corresponding to BCMA-28 as set forth in Table 15A.

1228. The CD2 binding molecule of embodiment 1187, wherein ABM3 binds BCMA and comprises the amino acid sequence of the scFv corresponding to BCMA-29 as set forth in Table 15A.

1229. The CD2 binding molecule of embodiment 1187, wherein ABM3 binds BCMA and comprises the amino acid sequence of the scFv corresponding to BCMA-30 as set forth in Table 15A.

1230. The CD2 binding molecule of embodiment 1187, wherein ABM3 binds BCMA and comprises the amino acid sequence of the scFv corresponding to BCMA-31 as set forth in Table 15A.

1231. The CD2 binding molecule of embodiment 1187, wherein ABM3 binds BCMA and comprises the amino acid sequence of the scFv corresponding to BCMA-32 as set forth in Table 15A.

1232. The CD2 binding molecule of embodiment 1187, wherein ABM3 binds BCMA and comprises the amino acid sequence of the scFv corresponding to BCMA-33 as set forth in Table 15A.

1233. The CD2 binding molecule of embodiment 1187, wherein ABM3 binds BCMA and comprises the amino acid sequence of the scFv corresponding to BCMA-34 as set forth in Table 15A.

1234. The CD2 binding molecule of embodiment 1187, wherein ABM3 binds BCMA and comprises the amino acid sequence of the scFv corresponding to BCMA-35 as set forth in Table 15A.

1235. The CD2 binding molecule of embodiment 1187, wherein ABM3 binds BCMA and comprises the amino acid sequence of the scFv corresponding to BCMA-36 as set forth in Table 15A.

1236. The CD2 binding molecule of embodiment 1187, wherein ABM3 binds BCMA and comprises the amino acid sequence of the scFv corresponding to BCMA-37 as set forth in Table 15A.

1237. The CD2 binding molecule of embodiment 1187, wherein ABM3 binds BCMA and comprises the amino acid sequence of the scFv corresponding to BCMA-38 as set forth in Table 15A.

1238. The CD2 binding molecule of embodiment 1187, wherein ABM3 binds BCMA and comprises the amino acid sequence of the scFv corresponding to BCMA-39 as set forth in Table 15A.

1239. The CD2 binding molecule of embodiment 1187, wherein ABM3 binds BCMA and comprises the amino acid sequence of the scFv corresponding to BCMA-40 as set forth in Table 15A.

1240. The CD2 binding molecule of embodiment 1186, wherein ABM3 is a Fab.

1241. The CD2 binding molecule of any one of embodiments 30 to 1240, in which each antigen-binding module is capable of binding its respective target at the same time as each of the other antigen-binding modules is bound to its respective target.

1242. The CD2 binding molecule of any one of embodiments 30 to 1241, which comprises a first variant Fc region and a second variant Fc region that together form an Fc heterodimer.

1243. The CD2 binding molecule of any one of embodiments 917 to 1241, which comprises:
  (a) a first monomer or half antibody comprising:
    (i) a first chain comprising a first variant Fc region and a first heavy chain variable domain;
    (ii) the variant CD58 domain; and
  (b) a second monomer or half antibody comprising:
    (i) a second chain comprising a second variant Fc region and first heavy chain variable domain;
    (ii) a second scFv domain; and (c) a third chain comprising a light chain constant domain and a light chain variable domain; wherein
the first and second variant Fc regions form a heterodimer,
the first heavy chain variable domain and the light chain variable domain form ABM2, and
the second scFv domain forms ABM3.

1244. The CD2 binding molecule of any one of embodiments 917 to 1241, which comprises:
(a) a first monomer or half antibody comprising:
  (i) a first chain comprising a first variant Fc region and a first heavy chain variable domain;
  (ii) a first scFv domain; and
(b) a second monomer or half antibody comprising:
  (i) a second chain comprising a second variant Fc region and first heavy chain variable domain;
  (ii) the variant CD58 domain; and
(c) a third chain comprising a light chain constant domain and a light chain variable domain; wherein
the first and second variant Fc regions form a heterodimer,
the first heavy chain variable domain and the light chain variable domain form ABM2, and
the first scFv domain forms ABM3.

1245. The CD2 binding molecule of any one of embodiments 917 to 1241, which comprises:
(a) a first monomer or half antibody comprising:
  (i) a first chain comprising a first variant Fc region and a first heavy chain variable domain;
  (ii) a first scFv domain; and
(b) a second monomer or half antibody comprising:
  (i) a second chain comprising a second variant Fc region and first heavy chain variable domain;
  (ii) the variant CD58 domain; and
(c) a third chain comprising a light chain constant domain and a light chain variable domain; wherein:
the first and second variant Fc regions form a heterodimer,
the first heavy chain variable domain and the light chain variable domain form ABM3, and
the first scFv domain forms ABM2.

1246. The CD2 binding molecule of any one of embodiments 917 to 1241, which comprises:
(a) a first monomer or half antibody comprising:
  (i) a first chain comprising a first variant Fc region and a first heavy chain variable domain;
  (ii) the variant CD58 domain; and
(b) a second monomer or half antibody comprising:
  (i) a second chain comprising a second variant Fc region and first heavy chain variable domain;
  (ii) a second scFv domain; and
(c) a third chain comprising a light chain constant domain and a light chain variable domain; wherein
the first and second variant Fc regions form a heterodimer,
the first heavy chain variable domain and the light chain variable domain form ABM3, and
the second scFv domain forms ABM2.

1247. The CD2 binding molecule of embodiment any of embodiments 1243 to 1246, wherein said first and second scFv domains are covalently attached to the C-terminus of said first and second chains, respectively.

1248. The CD2 binding molecule of embodiment any of embodiments 1243 to 1246, wherein said first and second scFv domains are covalently attached to the N-terminus of said first and second chains, respectively.

1249. The CD2 binding molecule of embodiment any of embodiments 1243 to 1248, wherein each of the scFv domains is attached between said Fc region and the CH domain of said chain.

1250. The CD2 binding molecule of embodiment any of embodiments 1243 to 1249, wherein the scFv domains are covalently attached using one or more domain linkers.

1251. The CD2 binding molecule of embodiment any of embodiments 1243 to 1250, wherein the scFv domains comprise at least one scFv linker.

1252. The CD2 binding molecule of embodiment 1251, wherein at least one scFv linker is charged.

1253. The CD2 binding molecule of embodiment 1252, wherein the charged linker is selected from L1 through L54.

1254. The CD2 binding molecule of any one of embodiments 1242 to 1253, wherein the first and second variant Fc regions comprise the amino acid substitutions S364K/E357Q:L368D/K370S.

1255. The CD2 binding molecule of any one of embodiments 1242 to 1253, wherein the first and second variant Fc regions comprise the amino acid substitutions L368D/K370S:S364K.

1256. The CD2 binding molecule of any one of embodiments 1242 to 1253, wherein the first and second variant Fc regions comprise the amino acid substitutions L368E/K370S:S364K.

1257. The CD2 binding molecule of any one of embodiments 1242 to 1253, wherein the first and second variant Fc regions comprise the amino acid substitutions T411T/E360E/Q362E:D401K.

1258. The CD2 binding molecule of any one of embodiments 1242 to 1253, wherein the first and second variant Fc regions comprise the amino acid substitutions L368D 370S: S364/E357L.

1259. The CD2 binding molecule of any one of embodiments 1242 to 1253, wherein the first and second variant Fc regions comprise the amino acid substitutions 370S:S364K/E357Q.

1260. The CD2 binding molecule of any one of embodiments 1242 to 1253, wherein the first and second variant Fc regions comprise the amino acid substitutions of any of the steric variants listed in FIG. 4 of WO 2014/110601.

1261. The CD2 binding molecule of any one of embodiments 1242 to 1253, wherein the first and second variant Fc regions comprise the amino acid substitutions of any of the variants listed in FIG. 5 of WO 2014/110601.

1262. The CD2 binding molecule of any one of embodiments 1242 to 1253, wherein the first and second variant Fc regions comprise the amino acid substitutions of any of the variants listed in FIG. 6 of WO 2014/110601.

1263. The CD2 binding molecule of any one of embodiments 1242 to 1262, wherein at least one of the Fc regions comprises an ablation variant modification.

1264. The CD2 binding molecule of embodiment 1263, wherein the ablation variant modifications are selected from Table 3.

1265. The CD2 binding molecule of embodiment 1264, wherein the ablation variant modification comprises G236R.

1266. The CD2 binding molecule of embodiment 1264, wherein the ablation variant modification comprises S239G.

1267. The CD2 binding molecule of embodiment 1264, wherein the ablation variant modification comprises S239K.

1268. The CD2 binding molecule of embodiment 1264, wherein the ablation variant modification comprises S239Q.

1269. The CD2 binding molecule of embodiment 1264, wherein the ablation variant modification comprises S239R.

1270. The CD2 binding molecule of embodiment 1264, wherein the ablation variant modification comprises V266D.

1271. The CD2 binding molecule of embodiment 1264, wherein the ablation variant modification comprises S267K.

1272. The CD2 binding molecule of embodiment 1264, wherein the ablation variant modification comprises S267R.

1273. The CD2 binding molecule of embodiment 1264, wherein the ablation variant modification comprises H268K.

1274. The CD2 binding molecule of embodiment 1264, wherein the ablation variant modification comprises E269R.

1275. The CD2 binding molecule of embodiment 1264, wherein the ablation variant modification comprises 299R.

1276. The CD2 binding molecule of embodiment 1264, wherein the ablation variant modification comprises 299K 1277. The CD2 binding molecule of embodiment 1264, wherein the ablation variant modification comprises K322A 1278. The CD2 binding molecule of embodiment 1264, wherein the ablation variant modification comprises A327G 1279. The CD2 binding molecule of embodiment 1264, wherein the ablation variant modification comprises A327L 1280. The CD2 binding molecule of embodiment 1264, wherein the ablation variant modification comprises A327N 1281. The CD2 binding molecule of embodiment 1264, wherein the ablation variant modification comprises A327Q 1282. The CD2 binding molecule of embodiment 1264, wherein the ablation variant modification comprises L328E 1283. The CD2 binding molecule of embodiment 1264, wherein the ablation variant modification comprises L328R 1284. The CD2 binding molecule of embodiment 1264, wherein the ablation variant modification comprises P329A 1285. The CD2 binding molecule of embodiment 1264, wherein the ablation variant modification comprises P329H 1286. The CD2 binding molecule of embodiment 1264, wherein the ablation variant modification comprises P329K 1287. The CD2 binding molecule of embodiment 1264, wherein the ablation variant modification comprises A330L 1288. The CD2 binding molecule of embodiment 1264, wherein the ablation variant modification comprises A330S/P331S 1289. The CD2 binding molecule of embodiment 1264, wherein the ablation variant modification comprises I332K 1290. The CD2 binding molecule of embodiment 1264, wherein the ablation variant modification comprises I332R 1291. The CD2 binding molecule of embodiment 1264, wherein the ablation variant modification comprises V266D/A327Q 1292. The CD2 binding molecule of embodiment 1264, wherein the ablation variant modification comprises V266D/P329K 1293. The CD2 binding molecule of embodiment 1264, wherein the ablation variant modification comprises G236R/L328R 1294. The CD2 binding molecule of embodiment 1264, wherein the ablation variant modification comprises E233P/L234V/L235A/G236del/S239K.

1295. The CD2 binding molecule of embodiment 1264, wherein the ablation variant modification comprises E233P/L234V/L235A/G236del/S267K.

1296. The CD2 binding molecule of embodiment 1264, wherein the ablation variant modification comprises E233P/L234V/L235A/G236del/S239K/A327G.

1297. The CD2 binding molecule of embodiment 1264, wherein the ablation variant modification comprises E233P/L234V/L235A/G236del/S267K/A327G.

1298. The CD2 binding molecule of embodiment 1264, wherein the ablation variant modification comprises E233P/L234V/L235A/G236del.

1299. The CD2 binding molecule of embodiment 1264, wherein the ablation variant modification comprises S239K/S267K.

1300. The CD2 binding molecule of embodiment 1264, wherein the ablation variant modification comprises 267K/P329K.

1301. The CD2 binding molecule of embodiment 1264, wherein the ablation variant modification comprises D265A/N297A/P329A.

1302. The CD2 binding molecule of embodiment 1264, wherein the ablation variant modification comprises D265N/N297D/P329G.

1303. The CD2 binding molecule of embodiment 1264, wherein the ablation variant modification comprises D265E/N297Q/P329S.

1304. The CD2 binding molecule of any one of embodiments 1263 to 1303, wherein both variant Fc regions comprise the ablation variant modification.

1305. The CD2 binding molecule of any one of embodiments 1242 to 1304, wherein at least one of the Fc regions further comprises pI variant substitutions.

1306. The CD2 binding molecule of embodiment 1305, wherein said pI variant substitutions are selected from Table 4.

1307. The CD2 binding molecule of embodiment 1306, wherein the pI variant substitutions comprise the substitutions present in pI_ISO(−).

1308. The CD2 binding molecule of embodiment 1306, wherein the pI variant substitutions comprise the substitutions present in pI_(−)_isosteric_A.

1309. The CD2 binding molecule of embodiment 1306, wherein the pI variant substitutions comprise the substitutions present in pI_(−)_isosteric_B.

1310. The CD2 binding molecule of embodiment 1306, wherein the pI variant substitutions comprise the substitutions present in PI_ISO(+RR).

1311. The CD2 binding molecule of embodiment 1306, wherein the pI variant substitutions comprise the substitutions present in pI_ISO(+).

1312. The CD2 binding molecule of embodiment 1306, wherein the pI variant substitutions comprise the substitutions present in pI_(+)_isosteric_A.

1313. The CD2 binding molecule of embodiment 1306, wherein the pI variant substitutions comprise the substitutions present in pI_(+)_isosteric_B.

1314. The CD2 binding molecule of embodiment 1306, wherein the pI variant substitutions comprise the substitutions present in pI_(+)_isosteric_E269Q/E272Q.

1315. The CD2 binding molecule of embodiment 1306, wherein the pI variant substitutions comprise the substitutions present in pI_(+)_isosteric_E269Q/E283Q.

1316. The CD2 binding molecule of embodiment 1306, wherein the pI variant substitutions comprise the substitutions present in pI_(+)_isosteric_E272O/E283Q.

1317. The CD2 binding molecule of embodiment 1306, wherein the pI variant substitutions comprise the substitutions present in pI_(+)_isosteric_E269Q.

1318. The CD2 binding molecule of embodiment any of embodiments 1242 to 1317, wherein the first and/or second Fc region further comprises one or more amino acid substitution(s) selected from 434A, 434S, 428L, 308F, 259I, 428L/434S, 259I/308F, 436I/428L, 436I or V/434S, 436V/428L, 252Y, 252Y/254T/256E, 259I/308F/428L, 236A, 239D, 239E, 332E, 332D, 239D/332E, 267D, 267E, 328F, 267E/328F, 236A/332E, 239D/332E/330Y, 239D, 332E/330L, 236R, 328R, 236R/328R, 236N/267E, 243L, 298A and 299T.

1319. The CD2 binding molecule of embodiment any of embodiments 1242 to 1317, wherein the first and/or second Fc region further comprises one or more amino acid substitution comprises the amino acid substitution 434A, 434S or 434V.

1320. The CD2 binding molecule of embodiment 1319, wherein the first and/or second Fc region further comprises one or more amino acid substitution comprises the amino acid substitution 428L.

1321. The CD2 binding molecule of embodiment 1319 or embodiment 1320, wherein the first and/or second Fc region further comprises one or more amino acid substitution comprises the amino acid substitution 308F.

1322. The CD2 binding molecule of any one of embodiments 1319 to 1321, wherein the first and/or second Fc region further comprises one or more amino acid substitution comprises the amino acid substitution 259I.

1323. The CD2 binding molecule of any one of embodiments 1319 to 1322, wherein the first and/or second Fc region further comprises one or more amino acid substitution comprises the amino acid substitution 436I.

1324. The CD2 binding molecule of any one of embodiments 1319 to 1323, wherein the first and/or second Fc region further comprises one or more amino acid substitution comprises the amino acid substitution 252Y.

1325. The CD2 binding molecule of any one of embodiments 1319 to 1324, wherein the first and/or second Fc region further comprises one or more amino acid substitution comprises the amino acid substitution 254T.

1326. The CD2 binding molecule of any one of embodiments 1319 to 1325, wherein the first and/or second Fc region further comprises one or more amino acid substitution comprises the amino acid substitution 256E.

1327. The CD2 binding molecule of any one of embodiments 1319 to 1326, wherein the first and/or second Fc region further comprises one or more amino acid substitution comprises the amino acid substitution 239D or 239E.

1328. The CD2 binding molecule of any one of embodiments 1319 to 1327, wherein the first and/or second Fc region further comprises one or more amino acid substitution comprises the amino acid substitution 332E or 332D.

1329. The CD2 binding molecule of any one of embodiments 1319 to 1328, wherein the first and/or second Fc region further comprises one or more amino acid substitution comprises the amino acid substitution 267D or 267E.

1330. The CD2 binding molecule of any one of embodiments 1319 to 1329, wherein the first and/or second Fc region further comprises one or more amino acid substitution comprises the amino acid substitution 330L.

1331. The CD2 binding molecule of any one of embodiments 1319 to 1330, wherein the first and/or second Fc region further comprises one or more amino acid substitution comprises the amino acid substitution 236R or 236N.

1332. The CD2 binding molecule of any one of embodiments 1319 to 1331, wherein the first and/or second Fc region further comprises one or more amino acid substitution comprises the amino acid substitution 328R.

1333. The CD2 binding molecule of any one of embodiments 1319 to 1332, wherein the first and/or second Fc region further comprises one or more amino acid substitution comprises the amino acid substitution 243L.

1334. The CD2 binding molecule of any one of embodiments 1319 to 1333, wherein the first and/or second Fc region further comprises one or more amino acid substitution comprises the amino acid substitution 298A.

1335. The CD2 binding molecule of any one of embodiments 1319 to 1334, wherein the first and/or second Fc region further comprises one or more amino acid substitution comprises the amino acid substitution 299T.

1336. The CD2 binding molecule of embodiment 1242, wherein:
(a) the first and second variant Fc regions comprise the amino acid substitutions S364K/E357Q:L368D/K370S;
(b) the first and/or second variant Fc regions comprises the ablation variant modifications E233P/L234V/L235A/G236del/S267K, and
(c) the first and/or second variant Fc regions comprises the pI variant substitutions N208D/Q295E/N384D/Q418E/N421D (pI_(-)_isosteric_A).

1337. The CD2 binding molecule of embodiment 1336, wherein the first variant Fc region comprises the ablation variant modifications E233P/L234V/L235A/G236del/S267K.

1338. The CD2 binding molecule of any one of embodiments 1336 to 1337, wherein the second variant Fc region comprises the ablation variant modifications E233P/L234V/L235A/G236del/S267K.

1339. The CD2 binding molecule of any one of embodiments 1336 to 1338, wherein the first variant Fc region comprises the pI variant substitutions N208D/Q295E/N384D/Q418E/N421D (pI_(-)_isosteric_A).

1340. The CD2 binding molecule of any one of embodiments 1336 to 1339, wherein the second variant Fc region comprises the pI variant substitutions N208D/Q295E/N384D/Q418E/N421D (pI_(-)_isosteric_A).

1341. The CD2 binding molecule of any one of embodiments 1242 to 1340, wherein the first or second variant Fc region comprises an amino acid sequence which is at least 90% identical to SEQ ID NO:1335.

1342. The CD2 binding molecule of any one of embodiments 1242 to 1340, wherein the first or second variant Fc region comprises an amino acid sequence which is at least 95% identical to SEQ ID NO:1335.

1343. The CD2 binding molecule of any one of embodiments 1242 to 1340, wherein the first or second variant Fc region comprises the amino acid sequence of SEQ ID NO:1335 modified with the substitutions recited in any one of embodiments 1254 to 1340.

1344. The CD2 binding molecule of any one of embodiments 1242 to 1340, wherein the first or second variant Fc region comprises the amino acid sequence of SEQ ID NO:1335 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 1254 to 1340.

1345. The CD2 binding molecule of any one of 1242 to 1344, wherein the first or second variant Fc region comprises an amino acid sequence which is at least 90% identical to SEQ ID NO:1336.

1346. The CD2 binding molecule of any one of embodiments 1242 to 1344, wherein the first or second variant Fc region comprises an amino acid sequence which is at least 95% identical to SEQ ID NO:1336.

1347. The CD2 binding molecule of any one of embodiments 1242 to 1344, wherein the first or second variant Fc region comprises the amino acid sequence of SEQ ID NO:1336 modified with the substitutions recited in any one of embodiments 1254 to 1340.

1348. The CD2 binding molecule of any one of embodiments 1242 to 1344, wherein the first or second variant Fc region comprises the amino acid sequence of SEQ ID NO:1336 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 1254 to 1340.

1349. The CD2 binding molecule of any one of embodiments 1242 to 1344, wherein the first or second variant Fc region comprises an amino acid sequence which is at least 90% identical to SEQ ID NO:1337.

1350. The CD2 binding molecule of any one of embodiments 1242 to 1344, wherein the first or second variant Fc region comprises an amino acid sequence which is at least 95% identical to SEQ ID NO:1337.

1351. The CD2 binding molecule of any one of embodiments 1242 to 1344, wherein the first or second variant Fc region comprises the amino acid sequence of SEQ ID NO:1337 modified with the substitutions recited in any one of embodiments 1254 to 1340.

1352. The CD2 binding molecule of any one of embodiments 1242 to 1344, wherein the first or second variant Fc region comprises the amino acid sequence of SEQ ID NO:1337 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 1254 to 1340.

1353. The CD2 binding molecule of any one of embodiments 1242 to 1352, wherein the first or second variant Fc region comprises an amino acid sequence which is at least 90% identical to SEQ ID NO:1338.

1354. The CD2 binding molecule of any one of embodiments 1242 to 1352, wherein the first or second variant Fc region comprises an amino acid sequence which is at least 95% identical to SEQ ID NO:1338.

1355. The CD2 binding molecule of any one of embodiments 1242 to 1352, wherein the first or second variant Fc region comprises the amino acid sequence of SEQ ID NO:1338 modified with the substitutions recited in any one of embodiments 1254 to 1340.

1356. The CD2 binding molecule of any one of embodiments 1242 to 1352, wherein the first or second variant Fc region comprises the amino acid sequence of SEQ ID NO:1338 with a substitution at 1, 2, 3, 4, 5 or 6 of positions 233, 234, 235, 236, 237, 239, 265, 266, 267, 268, 269, 297, 299, 322, 327, 328, 329, 330, 331 and 332, optionally wherein one or more of the substitutions are substitutions recited in any one of embodiments 1254 to 1340.

1357. A conjugate comprising (a) the CD2 binding molecule of any one of embodiments 1 to 1356, and (b) an agent.

1358. The conjugate of embodiment 1357, wherein the agent is a therapeutic agent, a diagnostic agent, a masking moiety, a cleavable moiety, a stabilizing moiety or any combination thereof.

1359. The conjugate of embodiment 1358, wherein the agent is any of the agents described in Section 7.12.

1360. The conjugate of embodiment 1358, wherein the agent is any of the agents described in Section 7.13.

1361. The conjugate of any one of embodiments 1357 to 1360, wherein the CD2 binding molecule is conjugated to a radionuclide.

1362. The conjugate of any one of embodiments 1357 to 1360, wherein the CD2 binding molecule is conjugated to an alkylating agent.

1363. The conjugate of any one of embodiments 1357, wherein the CD2 binding molecule is conjugated to a topoisomerase inhibitor, which is optionally a topoisomerase I inhibitor or a topoisomerase II inhibitor.

1364. The conjugate of any one of embodiments 1357 to 1360, wherein the CD2 binding molecule is conjugated to a DNA damaging agent.

1365. The conjugate of any one of embodiments 1357 to 1360, wherein the CD2 binding molecule is conjugated to a DNA intercalating agent, optionally a groove binding agent such as a minor groove binding agent.

1366. The conjugate of any one of embodiments 1357 to 1360, wherein the CD2 binding molecule is conjugated to a RNA/DNA antimetabolite.

1367. The conjugate of any one of embodiments 1357 to 1360, wherein the CD2 binding molecule is conjugated to a kinase inhibitor.

1368. The conjugate of any one of embodiments 1357 to 1360, wherein the CD2 binding molecule is conjugated to a protein synthesis inhibitor.

1369. The conjugate of any one of embodiments 1357 to 1360, wherein the CD2 binding molecule is conjugated to a histone deacetylase (HDAC) inhibitor.

1370. The conjugate of any one of embodiments 1357 to 1360, wherein the CD2 binding molecule is conjugated to a mitochondrial inhibitor, which is optionally an inhibitor of a phosphoryl transfer reaction in mitochondria.

1371. The conjugate of any one of embodiments 1357 to 1360, wherein the CD2 binding molecule is conjugated to an antimitotic agent.

1372. The conjugate of any one of embodiments 1357 to 1360, wherein the CD2 binding molecule is conjugated to a maytansinoid.

1373. The conjugate of any one of embodiments 1357 to 1360, wherein the CD2 binding molecule is conjugated to a kinesin inhibitor.

1374. The conjugate of any one of embodiments 1357 to 1360, wherein the CD2 binding molecule is conjugated to a kinesin-like protein KIF11 inhibitor.

1375. The conjugate of any one of embodiments 1357 to 1360, wherein the CD2 binding molecule is conjugated to a V-ATPase (vacuolar-type H+-ATPase) inhibitor.

1376. The conjugate of any one of embodiments 1357 to 1360, wherein the CD2 binding molecule is conjugated to a pro-apoptotic agent.

1377. The conjugate of any one of embodiments 1357 to 1360, wherein the CD2 binding molecule is conjugated to a Bcl2 (B-cell lymphoma 2) inhibitor.

1378. The conjugate of any one of embodiments 1357 to 1360, wherein the CD2 binding molecule is conjugated to an MCL1 (myeloid cell leukemia 1) inhibitor.

1379. The conjugate of any one of embodiments 1357 to 1360, wherein the CD2 binding molecule is conjugated to a HSP90 (heat shock protein 90) inhibitor.

1380. The conjugate of any one of embodiments 1357 to 1360, wherein the CD2 binding molecule is conjugated to an IAP (inhibitor of apoptosis) inhibitor.

1381. The conjugate of any one of embodiments 1357 to 1360, wherein the CD2 binding molecule is conjugated to an mTOR (mechanistic target of rapamycin) inhibitor.

1382. The conjugate of any one of embodiments 1357 to 1360, wherein the CD2 binding molecule is conjugated to a microtubule stabilizer.

1383. The conjugate of any one of embodiments 1357 to 1360, wherein the CD2 binding molecule is conjugated to a microtubule destabilizer.

1384. The conjugate of any one of embodiments 1357 to 1360, wherein the CD2 binding molecule is conjugated to an auristatin.

1385. The conjugate of any one of embodiments 1357 to 1360, wherein the CD2 binding molecule is conjugated to a dolastatin.

1386. The conjugate of any one of embodiments 1357 to 1360, wherein the CD2 binding molecule is conjugated to a MetAP (methionine aminopeptidase).

1387. The conjugate of any one of embodiments 1357 to 1360, wherein the CD2 binding molecule is conjugated to a CRM1 (chromosomal maintenance 1) inhibitor.

1388. The conjugate of any one of embodiments 1357 to 1360, wherein the CD2 binding molecule is conjugated to a DPPIV (dipeptidyl peptidase IV) inhibitor.

1389. The conjugate of any one of embodiments 1357 to 1360, wherein the CD2 binding molecule is conjugated to a proteasome inhibitor.

1390. The conjugate of any one of embodiments 1357 to 1360, wherein the CD2 binding molecule is conjugated to a protein synthesis inhibitor.

1391. The conjugate of any one of embodiments 1357 to 1360, wherein the CD2 binding molecule is conjugated to a CDK2 (cyclin-dependent kinase 2) inhibitor.

1392. The conjugate of any one of embodiments 1357 to 1360, wherein the CD2 binding molecule is conjugated to a CDK9 (cyclin-dependent kinase 9) inhibitor.

1393. The conjugate of any one of embodiments 1357 to 1360, wherein the CD2 binding molecule is conjugated to a RNA polymerase inhibitor.

1394. The conjugate of any one of embodiments 1357 to 1360, wherein the CD2 binding molecule is conjugated to a DHFR (dihydrofolate reductase) inhibitor.

1395. The conjugate of any one of embodiments 1357 to 1394, wherein the agent is attached to the TBM with a linker, which is optionally a cleavable linker or a non-cleavable linker.

1396. A pharmaceutical composition comprising the CD2 binding molecule of any one of embodiments 1 to 29 and a pharmaceutically acceptable excipient.

1397. A method of treating an immune or inflammatory disorder, comprising administering to a subject in need thereof the CD2 binding molecule of any one of embodiments 1 to 29 or the pharmaceutical composition of embodiment 1396.

1398. The method of embodiment 1397, wherein the subject has an immune disorder.

1399. The method of embodiment 1398, wherein the immune disorder is an autoimmune disorder.

1400. The method of embodiment 1399, wherein the autoimmune disorder is characterized by increased infiltration of lymphocytes into dermal or epidermal tissues.

1401. The method of embodiment 1399 or embodiment 1400, wherein the autoimmune disorder is characterized by increased T cell activation or abnormal antigen presentation.

1402. The method of any one of embodiments 1399 to 1401, wherein the autoimmune disease is rheumatoid arthritis, psoriatic arthritis, ankylosing spondylitis, Reiter's Syndrome, systemic lupus erythematosus, dermatomyositis, Sjogren's syndrome, lupus erythematosus, multiple sclerosis, myasthenia gravis, psoriasis or transplant rejection.

1403. The method of embodiment 1402, wherein the autoimmune disease is rheumatoid arthritis.

1404. The method of embodiment 1402, wherein the autoimmune disease is psoriatic arthritis.

1405. The method of embodiment 1402, wherein the autoimmune disease is ankylosing spondylitis.

1406. The method of embodiment 1402, wherein the autoimmune disease is Reiter's Syndrome.

1407. The method of embodiment 1402, wherein the autoimmune disease is systemic lupus erythematosus.

1408. The method of embodiment 1402, wherein the autoimmune disease is dermatomyositis.

1409. The method of embodiment 1402, wherein the autoimmune disease is Sjogren's syndrome.

1410. The method of embodiment 1402, wherein the autoimmune disease is lupus erythematosus.

1411. The method of embodiment 1402, wherein the autoimmune disease is multiple sclerosis.

1412. The method of embodiment 1402, wherein the autoimmune disease is myasthenia gravis.

1413. The method of embodiment 1402, wherein the autoimmune disease is psoriasis.

1414. The method of embodiment 1402, wherein the autoimmune disease is transplant rejection.

1415. The method of embodiment 1397, wherein the subject has an inflammatory disease.

1416. The method of embodiment 1402, wherein the inflammatory disorder is Crohn's disease, lupus nephritis, ulcerative colitis, asthma, encephilitis, inflammatory bowel disease, chronic obstructive pulmonary disease (COPD), arthritis, an allergic disorder.

1417. The method of embodiment 1416, wherein the inflammatory disorder is Crohn's disease.

1418. The method of embodiment 1416, wherein the inflammatory disorder is lupus nephritis.

1419. The method of embodiment 1416, wherein the inflammatory disorder is ulcerative colitis.

1420. The method of embodiment 1416, wherein the inflammatory disorder is asthma.

1421. The method of embodiment 1416, wherein the inflammatory disorder is encephalitis.

1422. The method of embodiment 1416, wherein the inflammatory disorder is inflammatory bowel disease.

1423. The method of embodiment 1416, wherein the inflammatory disorder is chronic obstructive pulmonary disease (COPD).

1424. The method of embodiment 1416, wherein the inflammatory disorder is arthritis.

1425. The method of embodiment 1416, wherein the inflammatory disorder is an allergic disorder.

1426. The method of any one of embodiments 1397 to 1425, wherein the CD2 binding molecule is administered parenterally.

1427. A pharmaceutical composition comprising the CD2 binding molecule of any one of embodiments to 1 to 1356 or the conjugate of any one of embodiments 1357 to 1395 and (b) a pharmaceutically acceptable excipient.

1428. A method of treating a subject with cancer, comprising administering to a subject suffering from cancer an effective amount of the CD2 binding molecule of any one of embodiments 1 to 1356, the conjugate of any one of embodiments 1357 to 1395, or the pharmaceutical composition of embodiment 1427.

1429. The method of embodiment 1428, wherein the cancer is selected from HER2+ cancer, acute lymphoblastic leukemia (ALL), acute myeloid leukemia (AML), adrenocortical carcinoma, anal cancer, appendix cancer, astrocytoma, basal cell carcinoma, brain tumor, bile duct cancer, bladder cancer, bone cancer, breast cancer, bronchial tumor, Burkitt Lymphoma, carcinoma of unknown primary origin, cardiac tumor, cervical cancer, chordoma, chronic lymphocytic leukemia (CLL), chronic myelogenous leukemia (CML), chronic myeloproliferative neoplasm, colon cancer, colorectal cancer, craniopharyngioma, cutaneous T-cell lymphoma, ductal carcinoma, embryonal tumor, endometrial cancer, ependymoma, esophageal cancer, esthesioneuroblastoma, fibrous histiocytoma, Ewing sarcoma, eye cancer, germ cell tumor, gallbladder cancer, gastric cancer, gastrointestinal carcinoid tumor, gastrointestinal stromal tumor, gestational trophoblastic disease, glioma, head and neck cancer, hairy cell leukemia, hepatocellular cancer, histiocytosis, Hodgkin lymphoma, hypopharyngeal cancer, intraocular melanoma, islet cell tumor, Kaposi sarcoma, kidney cancer, Langerhans cell histiocytosis, laryngeal cancer, leukemia, lip and oral cavity cancer, liver cancer, lobular carcinoma in situ, lung cancer, lymphoma, macroglobulinemia, malignant fibrous histiocytoma, melanoma, Merkel cell carcinoma, mesothelioma, metastatic squamous neck cancer with occult primary, midline tract carcinoma involving NUT gene, mouth cancer, multiple endocrine neoplasia syndrome, multiple myeloma, mycosis fungoides, myelodysplastic syndrome, myelodysplastic/myeloproliferative neoplasm, nasal cavity and para-nasal sinus cancer, nasopharyngeal cancer, neuroblastoma, non-Hodgkin lymphoma, non-small cell lung cancer, oropharyngeal cancer, osteosarcoma, ovarian cancer, pancreatic cancer, papillomatosis, paraganglioma, parathyroid cancer, penile cancer, pharyngeal cancer, pheochromocytomas, pituitary tumor, pleuropulmonary blastoma, primary central nervous system lymphoma, prostate cancer, rectal cancer, renal cell cancer, renal pelvis and ureter cancer, retinoblastoma, rhabdoid tumor, salivary gland cancer, Sezary syndrome, skin cancer, small cell lung cancer, small intestine cancer, soft tissue sarcoma, spinal cord tumor, stomach cancer, T-cell lymphoma, teratoid tumor, testicular cancer, throat cancer, thymoma and thymic carcinoma, thyroid cancer, urethral cancer, uterine cancer, vaginal cancer, vulvar cancer, and Wilms tumor.

1430. The method of embodiment 1429, wherein the cancer is HER2+ cancer.

1431. The method of embodiment 1429, wherein the cancer is acute lymphoblastic leukemia (ALL).

1432. The method of embodiment 1429, wherein the cancer is acute myeloid leukemia (AML).

1433. The method of embodiment 1429, wherein the cancer is adrenocortical carcinoma.

1434. The method of embodiment 1429, wherein the cancer is anal cancer.

1435. The method of embodiment 1429, wherein the cancer is appendix cancer.

1436. The method of embodiment 1429, wherein the cancer is astrocytoma.

1437. The method of embodiment 1429, wherein the cancer is basal cell carcinoma.

1438. The method of embodiment 1429, wherein the cancer is brain tumor.

1439. The method of embodiment 1429, wherein the cancer is bile duct cancer.

1440. The method of embodiment 1429, wherein the cancer is bladder cancer.

1441. The method of embodiment 1429, wherein the cancer is bone cancer.

1442. The method of embodiment 1429, wherein the cancer is breast cancer.

1443. The method of embodiment 1429, wherein the cancer is bronchial tumor.

1444. The method of embodiment 1429, wherein the cancer is Burkitt Lymphoma.

1445. The method of embodiment 1429, wherein the cancer is carcinoma of unknown primary origin.

1446. The method of embodiment 1429, wherein the cancer is cardiac tumor.

1447. The method of embodiment 1429, wherein the cancer is cervical cancer.

1448. The method of embodiment 1429, wherein the cancer is chordoma.

1449. The method of embodiment 1429, wherein the cancer is chronic lymphocytic leukemia (CLL).

1450. The method of embodiment 1429, wherein the cancer is chronic myelogenous leukemia (CML).

1451. The method of embodiment 1429, wherein the cancer is chronic myeloproliferative neoplasm.

1452. The method of embodiment 1429, wherein the cancer is colon cancer.

1453. The method of embodiment 1429, wherein the cancer is colorectal cancer.

1454. The method of embodiment 1429, wherein the cancer is craniopharyngioma.

1455. The method of embodiment 1429, wherein the cancer is cutaneous T-cell lymphoma.

1456. The method of embodiment 1429, wherein the cancer is ductal carcinoma.

1457. The method of embodiment 1429, wherein the cancer is embryonal tumor.

1458. The method of embodiment 1429, wherein the cancer is endometrial cancer.

1459. The method of embodiment 1429, wherein the cancer is ependymoma.

1460. The method of embodiment 1429, wherein the cancer is esophageal cancer.

1461. The method of embodiment 1429, wherein the cancer is esthesioneuroblastoma.

1462. The method of embodiment 1429, wherein the cancer is fibrous histiocytoma.

1463. The method of embodiment 1429, wherein the cancer is Ewing sarcoma.

1464. The method of embodiment 1429, wherein the cancer is eye cancer.

1465. The method of embodiment 1429, wherein the cancer is germ cell tumor.

1466. The method of embodiment 1429, wherein the cancer is gallbladder cancer.

1467. The method of embodiment 1429, wherein the cancer is gastric cancer.

1468. The method of embodiment 1429, wherein the cancer is gastrointestinal carcinoid tumor.

1469. The method of embodiment 1429, wherein the cancer is gastrointestinal stromal tumor.

1470. The method of embodiment 1429, wherein the cancer is gestational trophoblastic disease.

1471. The method of embodiment 1429, wherein the cancer is glioma.

1472. The method of embodiment 1429, wherein the cancer is head and neck cancer.

1473. The method of embodiment 1429, wherein the cancer is hairy cell leukemia.

1474. The method of embodiment 1429, wherein the cancer is hepatocellular cancer.

1475. The method of embodiment 1429, wherein the cancer is histiocytosis.

1476. The method of embodiment 1429, wherein the cancer is Hodgkin lymphoma.

1477. The method of embodiment 1429, wherein the cancer is hypopharyngeal cancer.

1478. The method of embodiment 1429, wherein the cancer is intraocular melanoma.

1479. The method of embodiment 1429, wherein the cancer is islet cell tumor.

1480. The method of embodiment 1429, wherein the cancer is Kaposi sarcoma.

1481. The method of embodiment 1429, wherein the cancer is kidney cancer.

1482. The method of embodiment 1429, wherein the cancer is Langerhans cell histiocytosis.
1483. The method of embodiment 1429, wherein the cancer is laryngeal cancer.
1484. The method of embodiment 1429, wherein the cancer is leukemia.
1485. The method of embodiment 1429, wherein the cancer is lip cancer.
1486. The method of embodiment 1429, wherein the cancer is oral cavity cancer.
1487. The method of embodiment 1429, wherein the cancer is liver cancer.
1488. The method of embodiment 1429, wherein the cancer is lobular carcinoma in situ.
1489. The method of embodiment 1429, wherein the cancer is lung cancer.
1490. The method of embodiment 1429, wherein the cancer is lymphoma.
1491. The method of embodiment 1429, wherein the cancer is macroglobulinemia.
1492. The method of embodiment 1429, wherein the cancer is malignant fibrous histiocytoma.
1493. The method of embodiment 1429, wherein the cancer is melanoma.
1494. The method of embodiment 1429, wherein the cancer is Merkel cell carcinoma.
1495. The method of embodiment 1429, wherein the cancer is mesothelioma.
1496. The method of embodiment 1429, wherein the cancer is metastatic squamous neck cancer with occult primary.
1497. The method of embodiment 1429, wherein the cancer is midline tract carcinoma involving NUT gene.
1498. The method of embodiment 1429, wherein the cancer is mouth cancer.
1499. The method of embodiment 1429, wherein the cancer is multiple endocrine neoplasia syndrome.
1500. The method of embodiment 1429, wherein the cancer is multiple myeloma.
1501. The method of embodiment 1429, wherein the cancer is mycosis fungoides.
1502. The method of embodiment 1429, wherein the cancer is myelodysplastic syndrome.
1503. The method of embodiment 1429, wherein the cancer is myelodysplastic/myeloproliferative neoplasm.
1504. The method of embodiment 1429, wherein the cancer is nasal cavity cancer.
1505. The method of embodiment 1429, wherein the cancer is para-nasal sinus cancer.
1506. The method of embodiment 1429, wherein the cancer is nasopharyngeal cancer.
1507. The method of embodiment 1429, wherein the cancer is neuroblastoma.
1508. The method of embodiment 1429, wherein the cancer is non-Hodgkin lymphoma.
1509. The method of embodiment 1429, wherein the cancer is non-small cell lung cancer.
1510. The method of embodiment 1429, wherein the cancer is oropharyngeal cancer.
1511. The method of embodiment 1429, wherein the cancer is osteosarcoma.
1512. The method of embodiment 1429, wherein the cancer is ovarian cancer.
1513. The method of embodiment 1429, wherein the cancer is pancreatic cancer.
1514. The method of embodiment 1429, wherein the cancer is papillomatosis.
1515. The method of embodiment 1429, wherein the cancer is paraganglioma.
1516. The method of embodiment 1429, wherein the cancer is parathyroid cancer.
1517. The method of embodiment 1429, wherein the cancer is penile cancer.
1518. The method of embodiment 1429, wherein the cancer is pharyngeal cancer.
1519. The method of embodiment 1429, wherein the cancer is pheochromocytomas.
1520. The method of embodiment 1429, wherein the cancer is pituitary tumor.
1521. The method of embodiment 1429, wherein the cancer is pleuropulmonary blastoma.
1522. The method of embodiment 1429, wherein the cancer is primary central nervous system lymphoma.
1523. The method of embodiment 1429, wherein the cancer is prostate cancer.
1524. The method of embodiment 1429, wherein the cancer is rectal cancer.
1525. The method of embodiment 1429, wherein the cancer is renal cell cancer.
1526. The method of embodiment 1429, wherein the cancer is renal pelvis cancer.
1527. The method of embodiment 1429, wherein the cancer is ureter cancer.
1528. The method of embodiment 1429, wherein the cancer is retinoblastoma.
1529. The method of embodiment 1429, wherein the cancer is rhabdoid tumor.
1530. The method of embodiment 1429, wherein the cancer is salivary gland cancer.
1531. The method of embodiment 1429, wherein the cancer is Sezary syndrome.
1532. The method of embodiment 1429, wherein the cancer is skin cancer.
1533. The method of embodiment 1429, wherein the cancer is small cell lung cancer.
1534. The method of embodiment 1429, wherein the cancer is small intestine cancer.
1535. The method of embodiment 1429, wherein the cancer is soft tissue sarcoma.
1536. The method of embodiment 1429, wherein the cancer is spinal cord tumor.
1537. The method of embodiment 1429, wherein the cancer is stomach cancer.
1538. The method of embodiment 1429, wherein the cancer is T-cell lymphoma.
1539. The method of embodiment 1429, wherein the cancer is teratoid tumor.
1540. The method of embodiment 1429, wherein the cancer is testicular cancer.
1541. The method of embodiment 1429, wherein the cancer is throat cancer.
1542. The method of embodiment 1429, wherein the cancer is thymoma.
1543. The method of embodiment 1429, wherein the cancer is thymic carcinoma.
1544. The method of embodiment 1429, wherein the cancer is thyroid cancer.
1545. The method of embodiment 1429, wherein the cancer is urethral cancer.
1546. The method of embodiment 1429, wherein the cancer is uterine cancer.
1547. The method of embodiment 1429, wherein the cancer is vaginal cancer.

1548. The method of embodiment 1429, wherein the cancer is vulvar cancer.

1549. The method of embodiment 1429, wherein the cancer is Wilms tumor.

1550. The method of any one of embodiments 1428 to 1549, further comprising administering at least one further agent to the subject.

1551. A nucleic acid or plurality of nucleic acids encoding the CD2 binding molecule of any one embodiments 1 to 1335.

1552. The nucleic acid or plurality of nucleic acids of embodiment 1551 which is a DNA (are DNAs).

1553. The nucleic acid or plurality of nucleic acids of embodiment 1552 which are in the form of one or more vectors, optionally expression vectors.

1554. The nucleic acid or plurality of nucleic acids of embodiment 1551 which is a mRNA (are mRNAs).

1555. A cell engineered to express the CD2 binding molecule of any one embodiments 1 to 1335.

1556. A cell transfected with one or more expression vectors comprising one or more nucleic acid sequences encoding the CD2 binding molecule of any one embodiments 1 to 1335 under the control of one or more promoters.

1557. The cell of embodiment 1555 or embodiment 1556, wherein expression of the CD2 binding molecule is under the control of an inducible promoter.

1558. The cell of any one of embodiments 1555 to 1557, wherein the CD2 binding molecule is produced in secretable form.

1559. A method of producing a CD2 binding molecule, comprising:
  (a) culturing the cell of any one of embodiments 1555 to 1558 in conditions under which the CD2 binding molecule is expressed; and
  (b) recovering the CD2 binding molecule from the cell culture.

1560. A CD3 binding molecule comprising the CDR sequences of CD3-129.

1561. The CD3 binding molecule of embodiment 1560, wherein the CDRs are defined by Kabat numbering, as set forth in Table 12B.

1562. The CD3 binding molecule of embodiment 1560, which comprises the heavy and light chain variable sequences of CD3-129 as set forth in Table 12A.

1563. The CD3 binding molecule of embodiment 1562, comprising the CD3-129 scFv sequence set forth in Table 12A.

1564. A CD3 binding molecule comprising the CDR sequences of CD3-130.

1565. The CD3 binding molecule of embodiment 1564, wherein the CDRs are defined by Kabat numbering, as set forth in Table 12B.

1566. The CD3 binding molecule of embodiment 1564, which comprises the heavy and light chain variable sequences of CD3-130 as set forth in Table 12A.

1567. The CD3 binding molecule of embodiment 1566, comprising the CD3-130 scFv sequence set forth in Table 12A.

1568. The CD3 binding molecule of any one of embodiments 1560 to 1567, which is an antibody fragment.

1569. The CD3 binding molecule of embodiment 1568, wherein the antibody fragment is a scFv.

1570. The CD3 binding molecule of any one of embodiments 1560 to 1567, which is in the form of an antibody.

1571. The CD3 binding molecule of any one of embodiments 1560 to 1567, which is a monospecific antibody.

1572. The CD3 binding molecule of any one of embodiments 1560 to 1567, which is a multispecific binding molecule (MBM) comprising:
  (a) an antigen-binding module 1 (ABM1) that binds specifically to CD3; and
  (b) an antigen-binding module 2 (ABM2) that binds specifically to a different target molecule.

1573. The CD3 binding molecule of embodiment 1572, wherein ABM2 specifically binds to a tumor associated antigen (TAA).

1574. The CD3 binding molecule of embodiment 1573, wherein ABM2 is an anti-TAA antibody or an antigen-binding domain thereof.

1575. The CD3 binding molecule of embodiment 1574, wherein the TAA is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

1576. The CD3 binding molecule of embodiment 1574, wherein the anti-TAA antibody or antigen-binding domain thereof has the CDR sequences of an antibody set forth in Table 14A or Table 14B.

1577. The CD3 binding molecule of embodiment 1574, wherein the anti-TAA antibody or antigen-binding domain thereof has the heavy and light chain variable region sequences of an antibody set forth in Table 14A or Table 14B.

1578. The CD3 binding molecule of embodiment 1574, wherein the TAA is CD19.

1579. The CD3 binding molecule of embodiment 1578, wherein the anti-TAA antibody or antigen-binding domain thereof comprises heavy chain CDRs having the amino acid sequences of CD19-H1, CD19-H2A, and CD19-H3 as set forth in Table 16 and light chain CDRs having the amino acid sequences of CD19-L1, CD19-L2, and CD19-L3 as set forth in Table 16.

1580. The CD3 binding molecule of embodiment 1578, wherein the anti-TAA antibody or antigen-binding domain thereof comprises a heavy chain variable region having the amino acid sequences of VHA as set forth in Table 16 and a light chain variable region having the amino acid sequences of VLA as set forth in Table 16.

1581. The CD3 binding molecule of embodiment 1578, wherein the anti-TAA antibody or antigen-binding domain thereof comprises heavy chain CDRs having the amino acid sequences of CD19-H1, CD19-H2B, and CD19-H3 as set forth in Table 16 and light chain CDRs having the amino acid sequences of CD19-L1, CD19-L2, and CD19-L3 as set forth in Table 16.

1582. The CD3 binding molecule of embodiment 1578, wherein the anti-TAA antibody or antigen-binding domain thereof comprises a heavy chain variable region having the amino acid sequences of VHB as set forth in Table 16 and a light chain variable region having the amino acid sequences of VLB as set forth in Table 16.

1583. The CD3 binding molecule of embodiment 1578, wherein the anti-TAA antibody or antigen-binding domain thereof comprises heavy chain CDRs having the amino acid sequences of CD19-H1, CD19-H2C, and CD19-H3 as set forth in Table 16 and light chain CDRs having the amino acid sequences of CD19-L1, CD19-L2, and CD19-L3 as set forth in Table 16.

1584. The CD3 binding molecule of embodiment 1578, wherein the anti-TAA antibody or antigen-binding domain thereof comprises a heavy chain variable region having the amino acid sequences of VHC as set forth in Table 16 and a light chain variable region having the amino acid sequences of VLB as set forth in Table 16.

1585. The CD3 binding molecule of embodiment 1578, wherein the anti-TAA antibody or antigen-binding domain thereof comprises heavy chain CDRs having the amino acid sequences of CD19-H1, CD19-H2D, and CD19-H3 as set forth in Table 16 and light chain CDRs having the amino acid sequences of CD19-L1, CD19-L2, and CD19-L3 as set forth in Table 16.

1586. The CD3 binding molecule of embodiment 1578, wherein the anti-TAA antibody or antigen-binding domain thereof comprises a heavy chain variable region having the amino acid sequences of VHD as set forth in Table 16 and a light chain variable region having the amino acid sequences of VLB as set forth in Table 16.

1587. The CD3 binding molecule of embodiment 1574, wherein the TAA is Her2.

1588. The CD3 binding molecule of embodiment 1574, wherein the TAA is mesothelin.

1589. The CD3 binding molecule of embodiment 1574, wherein the TAA is BCMA.

1590. The CD3 binding molecule of embodiment 1589, wherein ABM2 comprises the CDR sequences of BCMA-1.

1591. The CD3 binding molecule of embodiment 1589, wherein ABM2 comprises the CDR sequences of BCMA-2.

1592. The CD3 binding molecule of embodiment 1589, wherein ABM2 comprises the CDR sequences of BCMA-3.

1593. The CD3 binding molecule of embodiment 1589, wherein ABM2 comprises the CDR sequences of BCMA-4.

1594. The CD3 binding molecule of embodiment 1589, wherein ABM2 comprises the CDR sequences of BCMA-5.

1595. The CD3 binding molecule of embodiment 1589, wherein ABM2 comprises the CDR sequences of BCMA-6.

1596. The CD3 binding molecule of embodiment 1589, wherein ABM2 comprises the CDR sequences of BCMA-7.

1597. The CD3 binding molecule of embodiment 1589, wherein ABM2 comprises the CDR sequences of BCMA-8.

1598. The CD3 binding molecule of embodiment 1589, wherein ABM2 comprises the CDR sequences of BCMA-9.

1599. The CD3 binding molecule of embodiment 1589, wherein ABM2 comprises the CDR sequences of BCMA-10.

1600. The CD3 binding molecule of embodiment 1589, wherein ABM2 comprises the CDR sequences of BCMA-11.

1601. The CD3 binding molecule of embodiment 1589, wherein ABM2 comprises the CDR sequences of BCMA-12.

1602. The CD3 binding molecule of embodiment 1589, wherein ABM2 comprises the CDR sequences of BCMA-13.

1603. The CD3 binding molecule of embodiment 1589, wherein ABM2 comprises the CDR sequences of BCMA-14.

1604. The CD3 binding molecule of embodiment 1589, wherein ABM2 comprises the CDR sequences of BCMA-15.

1605. The CD3 binding molecule of embodiment 1589, wherein ABM2 comprises the CDR sequences of BCMA-16.

1606. The CD3 binding molecule of embodiment 1589, wherein ABM2 comprises the CDR sequences of BCMA-17.

1607. The CD3 binding molecule of embodiment 1589, wherein ABM2 comprises the CDR sequences of BCMA-18.

1608. The CD3 binding molecule of embodiment 1589, wherein ABM2 comprises the CDR sequences of BCMA-19.

1609. The CD3 binding molecule of embodiment 1589, wherein ABM2 comprises the CDR sequences of BCMA-20.

1610. The CD3 binding molecule of embodiment 1589, wherein ABM2 comprises the CDR sequences of BCMA-21.

1611. The CD3 binding molecule of embodiment 1589, wherein ABM2 comprises the CDR sequences of BCMA-22.

1612. The CD3 binding molecule of embodiment 1589, wherein ABM2 comprises the CDR sequences of BCMA-23.

1613. The CD3 binding molecule of embodiment 1589, wherein ABM2 comprises the CDR sequences of BCMA-24.

1614. The CD3 binding molecule of embodiment 1589, wherein ABM2 comprises the CDR sequences of BCMA-25.

1615. The CD3 binding molecule of embodiment 1589, wherein ABM2 comprises the CDR sequences of BCMA-26.

1616. The CD3 binding molecule of embodiment 1589, wherein ABM2 comprises the CDR sequences of BCMA-27.

1617. The CD3 binding molecule of embodiment 1589, wherein ABM2 comprises the CDR sequences of BCMA-28.

1618. The CD3 binding molecule of embodiment 1589, wherein ABM2 comprises the CDR sequences of BCMA-29.

1619. The CD3 binding molecule of embodiment 1589, wherein ABM2 comprises the CDR sequences of BCMA-30.

1620. The CD3 binding molecule of embodiment 1589, wherein ABM2 comprises the CDR sequences of BCMA-31.

1621. The CD3 binding molecule of embodiment 1589, wherein ABM2 comprises the CDR sequences of BCMA-32.

1622. The CD3 binding molecule of embodiment 1589, wherein ABM2 comprises the CDR sequences of BCMA-33.

1623. The CD3 binding molecule of embodiment 1589, wherein ABM2 comprises the CDR sequences of BCMA-34.

1624. The CD3 binding molecule of embodiment 1589, wherein ABM2 comprises the CDR sequences of BCMA-35.

1625. The CD3 binding molecule of embodiment 1589, wherein ABM2 comprises the CDR sequences of BCMA-36.

1626. The CD3 binding molecule of embodiment 1589, wherein ABM2 comprises the CDR sequences of BCMA-37.

1627. The CD3 binding molecule of embodiment 1589, wherein ABM2 comprises the CDR sequences of BCMA-38.

1628. The CD3 binding molecule of embodiment 1589, wherein ABM2 comprises the CDR sequences of BCMA-39.

1629. The CD3 binding molecule of embodiment 1589, wherein ABM2 comprises the CDR sequences of BCMA-40.

1630. The CD3 binding molecule of any one of embodiments 1590 to 1629, wherein the CDRs are defined by Kabat numbering, as set forth in Tables 15B and 15E.

1631. The CD3 binding molecule of any one of embodiments 1590 to 1629, wherein the CDRs are defined by Chothia numbering, as set forth in Tables 15C and 15F.

1632. CD3 binding molecule of any one of embodiments 1590 to 1629, wherein the CDRs are defined by a combination of Kabat and Chothia numbering, as set forth in Tables 15D and 15G.

1633. The CD3 binding molecule of embodiment 1589, wherein ABM2 comprises the heavy and light chain variable sequences of BCMA-1, as set forth in Table 15A.

1634. The CD3 binding molecule of embodiment 1589, wherein ABM2 comprises the heavy and light chain variable sequences of BCMA-2, as set forth in Table 15A.

1635. The CD3 binding molecule of embodiment 1589, wherein ABM2 comprises the heavy and light chain variable sequences of BCMA-3, as set forth in Table 15A.

1636. The CD3 binding molecule of embodiment 1589, wherein ABM2 comprises the heavy and light chain variable sequences of BCMA-4, as set forth in Table 15A.

1637. The CD3 binding molecule of embodiment 1589, wherein ABM2 comprises the heavy and light chain variable sequences of BCMA-5, as set forth in Table 15A.

1638. The CD3 binding molecule of embodiment 1589, wherein ABM2 comprises the heavy and light chain variable sequences of BCMA-6, as set forth in Table 15A.

1639. The CD3 binding molecule of embodiment 1589, wherein ABM2 comprises the heavy and light chain variable sequences of BCMA-7, as set forth in Table 15A.

1640. The CD3 binding molecule of embodiment 1589, wherein ABM2 comprises the heavy and light chain variable sequences of BCMA-8, as set forth in Table 15A.

1641. The CD3 binding molecule of embodiment 1589, wherein ABM2 comprises the heavy and light chain variable sequences of BCMA-9, as set forth in Table 15A.

1642. The CD3 binding molecule of embodiment 1589, wherein ABM2 comprises the heavy and light chain variable sequences of BCMA-10, as set forth in Table 15A.

1643. The CD3 binding molecule of embodiment 1589, wherein ABM2 comprises the heavy and light chain variable sequences of BCMA-11, as set forth in Table 15A.

1644. The CD3 binding molecule of embodiment 1589, wherein ABM2 comprises the heavy and light chain variable sequences of BCMA-12, as set forth in Table 15A.

1645. The CD3 binding molecule of embodiment 1589, wherein ABM2 comprises the heavy and light chain variable sequences of BCMA-13, as set forth in Table 15A.

1646. The CD3 binding molecule of embodiment 1589, wherein ABM2 comprises the heavy and light chain variable sequences of BCMA-14, as set forth in Table 15A.

1647. The CD3 binding molecule of embodiment 1589, wherein ABM2 comprises the heavy and light chain variable sequences of BCMA-15, as set forth in Table 15A.

1648. The CD3 binding molecule of embodiment 1589, wherein ABM2 comprises the heavy and light chain variable sequences of BCMA-16, as set forth in Table 15A.

1649. The CD3 binding molecule of embodiment 1589, wherein ABM2 comprises the heavy and light chain variable sequences of BCMA-17, as set forth in Table 15A.

1650. The CD3 binding molecule of embodiment 1589, wherein ABM2 comprises the heavy and light chain variable sequences of BCMA-18, as set forth in Table 15A.

1651. The CD3 binding molecule of embodiment 1589, wherein ABM2 comprises the heavy and light chain variable sequences of BCMA-19, as set forth in Table 15A.

1652. The CD3 binding molecule of embodiment 1589, wherein ABM2 comprises the heavy and light chain variable sequences of BCMA-20, as set forth in Table 15A.

1653. The CD3 binding molecule of embodiment 1589, wherein ABM2 comprises the heavy and light chain variable sequences of BCMA-21, as set forth in Table 15A.

1654. The CD3 binding molecule of embodiment 1589, wherein ABM2 comprises the heavy and light chain variable sequences of BCMA-22, as set forth in Table 15A.

1655. The CD3 binding molecule of embodiment 1589, wherein ABM2 comprises the heavy and light chain variable sequences of BCMA-23, as set forth in Table 15A.

1656. The CD3 binding molecule of embodiment 1589, wherein ABM2 comprises the heavy and light chain variable sequences of BCMA-24, as set forth in Table 15A.

1657. The CD3 binding molecule of embodiment 1589, wherein ABM2 comprises the heavy and light chain variable sequences of BCMA-25, as set forth in Table 15A.

1658. The CD3 binding molecule of embodiment 1589, wherein ABM2 comprises the heavy and light chain variable sequences of BCMA-26, as set forth in Table 15A.

1659. The CD3 binding molecule of embodiment 1589, wherein ABM2 comprises the heavy and light chain variable sequences of BCMA-27, as set forth in Table 15A.

1660. The CD3 binding molecule of embodiment 1589, wherein ABM2 comprises the heavy and light chain variable sequences of BCMA-28, as set forth in Table 15A.

1661. The CD3 binding molecule of embodiment 1589, wherein ABM2 comprises the heavy and light chain variable sequences of BCMA-29, as set forth in Table 15A.

1662. The CD3 binding molecule of embodiment 1589, wherein ABM2 comprises the heavy and light chain variable sequences of BCMA-30, as set forth in Table 15A.

1663. The CD3 binding molecule of embodiment 1589, wherein ABM2 comprises the heavy and light chain variable sequences of BCMA-31, as set forth in Table 15A.

1664. The CD3 binding molecule of embodiment 1589, wherein ABM2 comprises the heavy and light chain variable sequences of BCMA-32, as set forth in Table 15A.

1665. The CD3 binding molecule of embodiment 1589, wherein ABM2 comprises the heavy and light chain variable sequences of BCMA-33, as set forth in Table 15A.

1666. The CD3 binding molecule of embodiment 1589, wherein ABM2 comprises the heavy and light chain variable sequences of BCMA-34, as set forth in Table 15A.

1667. The CD3 binding molecule of embodiment 1589, wherein ABM2 comprises the heavy and light chain variable sequences of BCMA-35, as set forth in Table 15A.

1668. The CD3 binding molecule of embodiment 1589, wherein ABM2 comprises the heavy and light chain variable sequences of BCMA-36, as set forth in Table 15A.

1669. The CD3 binding molecule of embodiment 1589, wherein ABM2 comprises the heavy and light chain variable sequences of BCMA-37, as set forth in Table 15A.

1670. The CD3 binding molecule of embodiment 1589, wherein ABM2 comprises the heavy and light chain variable sequences of BCMA-38, as set forth in Table 15A.

1671. The CD3 binding molecule of embodiment 1589, wherein ABM2 comprises the heavy and light chain variable sequences of BCMA-39, as set forth in Table 15A.

1672. The CD3 binding molecule of embodiment 1589, wherein ABM2 comprises the heavy and light chain variable sequences of BCMA-40, as set forth in Table 15A.

1673. The CD3 binding molecule of any one of embodiments 1572 to 1672, wherein ABM2 is an antibody, an antibody fragment, an scFv, a dsFv, a Fv, a Fab, an scFab, a (Fab')2, a single domain antibody (SDAB), a VH or VL domain, or a camelid VHH domain.

1674. The CD3 binding molecule of embodiment 1673, wherein ABM2 is an scFv.

1675. The CD3 binding molecule of any of embodiment 1673, wherein ABM2 is a Fab.

1676. The CD3 binding molecule of embodiment 1572, wherein if TAA is a receptor, ABM2 comprises a receptor binding domain of a ligand of the receptor, and if TAA is a ligand, ABM2 comprises a ligand binding domain of a receptor of the ligand.

1677. The CD3 binding molecule of embodiment 1676, wherein the TAA is TSHR, CD171, CS-1, CLL-1, GD3, Tn Ag, FLT3, CD38, CD44v6, B7H3, KIT, IL-13Ra2, IL-11Ra, PSCA, PRSS21, VEGFR2, LewisY, CD24, PDGFR-beta, SSEA-4, MUC1, EGFR, NCAM, CAIX, LMP2, EphA2, fucosyl GM1, sLe, GM3, TGS5, HMWMAA, o-acetyl-GD2, GD2, folate receptor alpha, folate receptor beta, TEM1/CD248, TEM7R, CLDN6, GPRC5D, CXORF61, CD97, CD179a, ALK, polysialic acid, PLAC1, GloboH, NY-BR-1, UPK2, HAVCR1, ADRB3, PANX3, GPR20, LY6K, OR51E2, TAARP, WT1, ETV6-AML, sperm protein 17, XAGE1, Tie 2, MAD-CT-1, MAD-CT-2, Fos-related antigen 1, p53 mutant, hTERT, sarcoma translocation breakpoints, ML-IAP, ERG (TMPRSS2 ETS fusion gene), NA17, PAX3, Androgen receptor, Cyclin B1, MYCN, RhoC, CYP1B1, BORIS, SART3, PAX5, OY-TES1, LCK, AKAP-4, SSX2, CD79a, CD79b, CD72, LAIR1, FCAR, LILRA2, CD300LF, CLEC12A, BST2, EMR2, LY75, GPC3, FCRL5, IGLL1, CD19, CD20, CD30, ERBB2, ROR1, FLT3, TAAG72, CD22, CD33, GD2, BCMA, gp100Tn, FAP, tyrosinase, EPCAM, CEA, Igf-I receptor, EphB2, mesothelin, Cadherin17, CD32b, EGFRvIII, GPNMB, GPR64, HER3, LRP6, LYPD8, NKG2D, SLC34A2, SLC39A6, SLITRK6, or TACSTD2.

1678. The CD3 binding molecule of any one of embodiments 1572 to 1677, which is a bispecific binding molecule.

1679. The CD3 binding molecule of any one of embodiments 1572 to 1677, which is a trispecific binding molecule (TBM) further comprising a third antigen-binding module (ABM3).

1680. The CD3 binding molecule of embodiment 1679, wherein ABM3 specifically binds to human CD2.

1681. The CD3 binding molecule of embodiment 1680, wherein ABM3 is a CD58 moiety.

1682. The CD3 binding molecule of embodiment 1681, wherein the CD58 moiety comprises the amino acid sequence of CD58-1 as set forth in Table 1.

1683. The CD3 binding molecule of embodiment 1681, wherein the CD58 moiety comprises the amino acid sequence of CD58-2 as set forth in Table 1.

1684. The CD3 binding molecule of embodiment 1681, wherein the CD58 moiety comprises the amino acid sequence of CD58-3 as set forth in Table 1.

1685. The CD3 binding molecule of embodiment 1681, wherein the CD58 moiety comprises the amino acid sequence of CD58-4 as set forth in Table 1.

1686. The CD3 binding molecule of embodiment 1681, wherein the CD58 moiety comprises the amino acid sequence of CD58-5 as set forth in Table 1.

1687. The CD3 binding molecule of embodiment 1686, wherein the amino acid designated as B is a phenylalanine.

1688. The CD3 binding molecule of embodiment 1686, wherein the amino acid designated as B is a serine.

1689. The CD3 binding molecule of any one of embodiments 1686 to 1688, wherein the amino acid designated as J is a valine.

1690. The CD3 binding molecule of any one of embodiments 1686 to 1688, wherein the amino acid designated as J is a lysine.

1691. The CD3 binding molecule of any one of embodiments 1686 to 1690, wherein the amino acid designated as O is a valine.

1692. The CD3 binding molecule of any one of embodiments 1686 to 1690, wherein the amino acid designated as O is a glutamine.

1693. The CD3 binding molecule of any one of embodiments 1686 to 1692, wherein the amino acid designated as U is a valine.

1694. The CD3 binding molecule of any one of embodiments 1686 to 1692, wherein the amino acid designated as U is a lysine.

1695. The CD3 binding molecule of any one of embodiments 1686 to 1694, wherein the amino acid designated as X is a threonine.

1696. The CD3 binding molecule of any one of embodiments 1686 to 1694, wherein the amino acid designated as X is a serine.

1697. The CD3 binding molecule of any one of embodiments 1686 to 1696, wherein the amino acid designated as Z is a leucine.

1698. The CD3 binding molecule of any one of embodiments 1686 to 1696, wherein the amino acid designated as Z is a glycine.

1699. The CD3 binding molecule of embodiment 1686, wherein the CD58 moiety comprises the amino acid sequence of CD58-6 as set forth in Table 1.

1700. The CD3 binding molecule of embodiment 1686, wherein the CD58 moiety comprises the amino acid sequence of CD58-7 as set forth in Table 1.

1701. The CD3 binding molecule of embodiment 1700, wherein the amino acid designated as J is a valine.

1702. The CD3 binding molecule of embodiment 1700, wherein the amino acid designated as J is a lysine.

1703. The CD3 binding molecule of any one of embodiments 1700 to 1702, wherein the amino acid designated as O is a valine.

1704. The CD3 binding molecule of any one of embodiments 1700 to 1702, wherein the amino acid designated as O is a glutamine.

1705. The CD3 binding molecule of embodiment 1686, wherein the CD58 moiety comprises the amino acid sequence of CD58-8 as set forth in Table 1.

1706. The CD3 binding molecule of embodiment 1686, wherein the CD58 moiety comprises the amino acid sequence of CD58-9 as set forth in Table 1.

1707. The CD3 binding molecule of embodiment 1686, wherein the CD58 moiety comprises the amino acid sequence of CD58-10 as set forth in Table 1.

1708. The CD3 binding molecule of embodiment 1686, wherein the CD58 moiety comprises the amino acid sequence of CD58-11 as set forth in Table 1.

1709. The CD3 binding molecule of any one of embodiments 1679 to 1708, which is a trispecific binding molecule.

10. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes. In the event that there are any inconsistencies between the teachings of one or more of the references incorporated herein and the present disclosure, the teachings of the present specification are intended.

SEQUENCE LISTING (1338 sequences)

SEQ ID NO: 1 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 2 - protein, 237 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNVL

SEQ ID NO: 3 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 4 - protein, 187 aa, Homo sapiens
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHR

SEQ ID NO: 5 - protein, 187 aa, Artificial Sequence; identical to SEQ ID NO: 4
  source: /note="Description of Artificial Sequence: Synthetic polypeptide"
  VARIANT (1)..(1): /replace="Ser"
  VARIANT (9)..(9): /replace="Lys"
  VARIANT (21)..(21): /replace="Gln"
  VARIANT (58)..(58): /replace="Lys"
  VARIANT (85)..(85): /replace="Ser"
  VARIANT (93)..(93): /replace="Gly"
  SITE (1)..(187): /note="Variant residues given in the sequence have no preference with respect to those in the annotations for variant positions"

SEQ ID NO: 6 - protein, 94 aa, Homo sapiens
SQQIYGVVYGNVTFHVPSNVPLKEVLWKKQKDKVAELENSEFRAFSSFKNRVYLDTVSGSLTIYNLTSSDEDEYEMESPNITDTMKFFLYVLES

SEQ ID NO: 7 - protein, 94 aa, Artificial Sequence; identical to SEQ ID NO: 6
  source: /note="Description of Artificial Sequence: Synthetic polypeptide"
  VARIANT (8)..(8): /replace="Lys"
  VARIANT (20)..(20): /replace="Gln"
  SITE (1)..(94): /note="Variant residues given in the sequence have no preference with respect to those in the annotations for variant positions"

SEQ ID NO: 8 - protein, 94 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLES

SEQ ID NO: 9 - protein, 94 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLES

SEQ ID NO: 10 - protein, 94 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLES

SEQ ID NO: 11 - protein, 94 aa, Artificial Sequence
  source: /note="Description of Artificial Sequence: Synthetic polypeptide"
SQQIYGVVYGNVTFHVPSNVPLKEVLCKKQKDKVAELENSEFRAFSSFKNRVYLDTVSGSCTIYNLTSSDEDEYEMESPNITDTMKFFLYVLES

SEQ ID NO: 12-157 - skipped (146 entries)

SEQ ID NO: 158 - protein, 7 aa, Artificial Sequence
  source: /note="Description of Artificial Sequence: Synthetic peptide"
DASNRAT

SEQ ID NO: 159-212 - skipped (54 entries)

SEQ ID NO: 213 - protein, 3 aa, Artificial Sequence
  source: /note="Description of Artificial Sequence: Synthetic peptide"
GTN

SEQ ID NO: 214-216 - skipped (3 entries)

SEQ ID NO: 217 - protein, 3 aa, Artificial Sequence
  source: /note="Description of Artificial Sequence: Synthetic peptide"
DAS

SEQ ID NO: 218-262 - skipped (45 entries)

SEQ ID NO: 263 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 264 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 265 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 266 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 267 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 268 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 269 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 270 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 271 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 272 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 273 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 274 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 275 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 276 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 277 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 278 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 279 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 280 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 281 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 282 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 283 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 284 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 285 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 286 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 287 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 288 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 289 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 290 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 291 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 292 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 293 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 294 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 295 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 296 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 297 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 298 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 299 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 300 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 301 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 302 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 303 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 304 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 305 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 306 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 307 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 308 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 309 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 310 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 311 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 312 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 313 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 314 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 315 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 316 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 317 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 318 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 319 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 320 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 321 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 322 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 323 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 324 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 325 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 326 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 327 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 328 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 329 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 330 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 331 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 332 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 333 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 334 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 335 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 336 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 337 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 338 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 339 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 340 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 341 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 342 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 343 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 344 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 345 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 346 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 347 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 348 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 349 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 350 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 351 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 352 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 353 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 354 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 355 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 356 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 357 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 358 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 359 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 360 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 361 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 362 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 363 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 364 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 365 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 366 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 367 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 368 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 369 - protein, 122 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSA

SEQ ID NO: 370 - protein, 107 aa, Artificial Sequence
  source: /note="Description of Artificial Sequence: Synthetic polypeptide"
DVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 371 - protein, 244 aa, Artificial Sequence
  source: /note="Description of Artificial Sequence: Synthetic polypeptide"
QIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSAGGGGSGGGGSGGGGSDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIK

SEQ ID NO: 372 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 373 - protein, 111 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIK

SEQ ID NO: 374 - protein, 249 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 375 - protein, 117 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSS

SEQ ID NO: 376 - protein, 111 aa, Artificial Sequence
  source: /note="Description of Artificial Sequence: Synthetic polypeptide"
DIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 377 - protein, 243 aa, Artificial Sequence
  source: /note="Description of Artificial Sequence: Synthetic polypeptide"
QIQLVQSGPELKKPGETVKISCKASGYTFRHYSMNWVKQAPGKGLKWMGRINTESGVPIYADDFKGRFAFSVETSASTAYLVINNLKDEDTASYFCSNDYLYSLDFWGQGTALTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 378 - protein, 117 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSS

SEQ ID NO: 379 - protein, 243 aa, Artificial Sequence
  source: /note="Description of Artificial Sequence: Synthetic polypeptide"
QIQLVQSGPELKKPGETVKISCKASGYTFTHYSMNWVKQAPGKGLKWMGRINTETGEPLYADDFKGRFAFSLETSASTAYLVINNLKNEDTATFFCSNDYLYSCDYWGQGTTLTVSSGGGGSGGGGSGGGGSDIVLTQSPPSLAMSLGKRATISCRASESVTILGSHLIYWYQQKPGQPPTLLIQLASNVQTGVPARFSGSGSRTDFTLTIDPVEEDDVAVYYCLQSRTIPRTFGGGTKLEIK

SEQ ID NO: 380 - protein, 11 aa, Artificial Sequence
  source: /note="Description of Artificial Sequence: Synthetic peptide"
RASQSISSYLN

SEQ ID NO: 381 - protein, 12 aa, Artificial Sequence
  source: /note="Description of Artificial Sequence: Synthetic peptide"
RASQSISSSFLA

SEQ ID NO: 382 - protein, 16 aa, Artificial Sequence
  source: /note="Description of Artificial Sequence: Synthetic peptide"
RSSQSLLHSNGYNYLD

SEQ ID NO: 383 - protein, 16 aa, Artificial Sequence
  source: /note="Description of Artificial Sequence: Synthetic peptide"
KSSQSLLRNDGKTPLY

SEQ ID NO: 384 - protein, 16 aa, Artificial Sequence
  source: /note="Description of Artificial Sequence: Synthetic peptide"
RSSQSLLHSNGYNYLN

SEQ ID NO: 385 - protein, 16 aa, Artificial Sequence
  source: /note="Description of Artificial Sequence: Synthetic peptide"
RSSQSLLYSNGYNYVD

SEQ ID NO: 386 - protein, 11 aa, Artificial Sequence
  source: /note="Description of Artificial Sequence: Synthetic peptide"
RASQSVSSNLA

SEQ ID NO: 387 - protein, 11 aa, Artificial Sequence
  source: /note="Description of Artificial Sequence: Synthetic peptide"
RASQSVSSKLA

SEQ ID NO: 388 - protein, 12 aa, Artificial Sequence
  source: /note="Description of Artificial Sequence: Synthetic peptide"
RASQSVGSTNLA

SEQ ID NO: 389 - protein, 16 aa, Artificial Sequence
  source: /note="Description of Artificial Sequence: Synthetic peptide"
KSSESLVHNSGKTYLN

SEQ ID NO: 390 - protein, 11 aa, Artificial Sequence
  source: /note="Description of Artificial Sequence: Synthetic peptide"
QASEDINKFLN

SEQ ID NO: 391 - protein, 11 aa, Artificial Sequence
  source: /note="Description of Artificial Sequence: Synthetic peptide"
RASQSVGSNLA

SEQ ID NO: 392 - protein, 12 aa, Artificial Sequence
  source: /note="Description of Artificial Sequence: Synthetic peptide"
RASQSIGSSSLA

SEQ ID NO: 393 - protein, 11 aa, Artificial Sequence
  source: /note="Description of Artificial Sequence: Synthetic peptide"
KASQDIDDAMN

SEQ ID NO: 394 - protein, 11 aa, Artificial Sequence
  source: /note="Description of Artificial Sequence: Synthetic peptide"
RASQDIYNNLA

SEQ ID NO: 395 - protein, 11 aa, Artificial Sequence
  source: /note="Description of Artificial Sequence: Synthetic peptide"
GGNNIGTKSVH

SEQ ID NO: 396 - protein, 11 aa, Artificial Sequence
  source: /note="Description of Artificial Sequence: Synthetic peptide"
SGDGLSKKYVS

SEQ ID NO: 397 - protein, 11 aa, Artificial Sequence
  source: /note="Description of Artificial Sequence: Synthetic peptide"
RASQGIRNWLA

SEQ ID NO: 398 - protein, 11 aa, Artificial Sequence
  source: /note="Description of Artificial Sequence: Synthetic peptide"
GGNNIGSKSVH

SEQ ID NO: 399 - protein, 11 aa, Artificial Sequence
  source: /note="Description of Artificial Sequence: Synthetic peptide"
QGDSLGNYYAT

SEQ ID NO: 400 - protein, 12 aa, Artificial Sequence
  source: /note="Description of Artificial Sequence: Synthetic peptide"
RASQSVSSAYLA

SEQ ID NO: 401 - protein, 11 aa, Artificial Sequence
  source: /note="Description of Artificial Sequence: Synthetic peptide"
RASQSVSNSLA

SEQ ID NO: 402 - protein, 12 aa, Artificial Sequence
  source: /note="Description of Artificial Sequence: Synthetic peptide"
RASQSVSSSFLA

SEQ ID NO: 403 - protein, 12 aa, Artificial Sequence
  source: /note="Description of Artificial Sequence: Synthetic peptide"
RASQSVSTTFLA

SEQ ID NO: 404 - protein, 12 aa, Artificial Sequence
  source: /note="Description of Artificial Sequence: Synthetic peptide"
RATQSIGSSFLA

SEQ ID NO: 405 - protein, 12 aa, Artificial Sequence
  source: /note="Description of Artificial Sequence: Synthetic peptide"
RASQSVSSSYLA

SEQ ID NO: 406 - protein, 12 aa, Artificial Sequence
  source: /note="Description of Artificial Sequence: Synthetic peptide"
RASQRVASNYLA

SEQ ID NO: 407 - protein, 12 aa, Artificial Sequence
  source: /note="Description of Artificial Sequence: Synthetic peptide"
RASQSLSSNFLA

SEQ ID NO: 408 - protein, 12 aa, Artificial Sequence
  source: /note="Description of Artificial Sequence: Synthetic peptide"
RASQSVASSFLA

SEQ ID NO: 409 - protein, 11 aa, Artificial Sequence
  source: /note="Description of Artificial Sequence: Synthetic peptide"
RASQDVNTAVS

SEQ ID NO: 410 - protein, 15 aa, Artificial Sequence
  source: /note="Description of Artificial Sequence: Synthetic peptide"
RASESVSVIGAHLIH

SEQ ID NO: 411 - protein, 15 aa, Artificial Sequence
  source: /note="Description of Artificial Sequence: Synthetic peptide"
RASESVTILGSHLIY

SEQ ID NO: 412 - protein, 7 aa, Artificial Sequence
  source: /note="Description of Artificial Sequence: Synthetic peptide"
AASSLQS

SEQ ID NO: 413 - protein, 7 aa, Artificial Sequence
  source: /note="Description of Artificial Sequence: Synthetic peptide"
GASRRAT

SEQ ID NO: 414 - protein, 7 aa, Artificial Sequence
  source: /note="Description of Artificial Sequence: Synthetic peptide"
LGSNRAS

SEQ ID NO: 415 - protein, 7 aa, Artificial Sequence
  source: /note="Description of Artificial Sequence: Synthetic peptide"
EVSNRFS

SEQ ID NO: 416 - protein, 7 aa, Artificial Sequence
  source: /note="Description of Artificial Sequence: Synthetic peptide"
LGSKRAS

SEQ ID NO: 417 - protein, 7 aa, Artificial Sequence
  source: /note="Description of Artificial Sequence: Synthetic peptide"
GASTLAS

SEQ ID NO: 418 - protein, 7 aa, Artificial Sequence
  source: /note="Description of Artificial Sequence: Synthetic peptide"
GASTRAS

SEQ ID NO: 419 - protein, 7 aa, Artificial Sequence
  source: /note="Description of Artificial Sequence: Synthetic peptide"
GASIRAT

SEQ ID NO: 420 - protein, 7 aa, Artificial Sequence
  source: /note="Description of Artificial Sequence: Synthetic peptide"
EVSNRDS

SEQ ID NO: 421 - protein, 7 aa, Artificial Sequence
  source: /note="Description of Artificial Sequence: Synthetic peptide"
DASTLQT

SEQ ID NO: 422 - protein, 7 aa, Artificial Sequence
  source: /note="Description of Artificial Sequence: Synthetic peptide"
GASTRAT

SEQ ID NO: 423 - protein, 7 aa, Artificial Sequence
  source: /note="Description of Artificial Sequence: Synthetic peptide"
GASSRAS

SEQ ID NO: 424 - protein, 7 aa, Artificial Sequence
  source: /note="Description of Artificial Sequence: Synthetic peptide"
SATSPVP

SEQ ID NO: 425 - protein, 7 aa, Artificial Sequence
  source: /note="Description of Artificial Sequence: Synthetic peptide"
AANKSQS

SEQ ID NO: 426 - protein, 7 aa, Artificial Sequence
  source: /note="Description of Artificial Sequence: Synthetic peptide"
DDSVRPS

SEQ ID NO: 427 - protein, 7 aa, Artificial Sequence
  source: /note="Description of Artificial Sequence: Synthetic peptide"
RDKERPS

SEQ ID NO: 428 - protein, 7 aa, Artificial Sequence
  source: /note="Description of Artificial Sequence: Synthetic peptide"
AASNLQS

SEQ ID NO: 429 - protein, 7 aa, Artificial Sequence
  source: /note="Description of Artificial Sequence: Synthetic peptide"
GKNNRPS

SEQ ID NO: 430 - protein, 7 aa, Artificial Sequence
  source: /note="Description of Artificial Sequence: Synthetic peptide"
GTNNRPS

SEQ ID NO: 431 - protein, 7 aa, Artificial Sequence
  source: /note="Description of Artificial Sequence: Synthetic peptide"
DASSRAT

SEQ ID NO: 432 - protein, 7 aa, Artificial Sequence
  source: /note="Description of Artificial Sequence: Synthetic peptide"
GASSRAT

SEQ ID NO: 433 - protein, 7 aa, Artificial Sequence
  source: /note="Description of Artificial Sequence: Synthetic peptide"
GSSNRAT

SEQ ID NO: 434 - protein, 7 aa, Artificial Sequence
  source: /note="Description of Artificial Sequence: Synthetic peptide"
GASQRAT

SEQ ID NO: 435 - protein, 7 aa, Artificial Sequence
  source: /note="Description of Artificial Sequence: Synthetic peptide"
GASNWAT

SEQ ID NO: 436 - protein, 7 aa, Artificial Sequence
  source: /note="Description of Artificial Sequence: Synthetic peptide"
GTSSRAT

SEQ ID NO: 437 - protein, 7 aa, Artificial Sequence
  source: /note="Description of Artificial Sequence: Synthetic peptide"
GASGRAT

SEQ ID NO: 438 - protein, 7 aa, Artificial Sequence
  source: /note="Description of Artificial Sequence: Synthetic peptide"
SASYRYT

SEQ ID NO: 439 - protein, 7 aa, Artificial Sequence
  source: /note="Description of Artificial Sequence: Synthetic peptide"
LASNLET

SEQ ID NO: 440 - protein, 7 aa, Artificial Sequence
  source: /note="Description of Artificial Sequence: Synthetic peptide"
LASNVQT

SEQ ID NO: 441 - protein, 9 aa, Artificial Sequence
  source: /note="Description of Artificial Sequence: Synthetic peptide"
QQSYSTPYT

SEQ ID NO: 442 - protein, 10 aa, Artificial Sequence
  source: /note="Description of Artificial Sequence: Synthetic peptide"
QQYHSSPSWT

SEQ ID NO: 443 - protein, 9 aa, Artificial Sequence
  source: /note="Description of Artificial Sequence: Synthetic peptide"
MQALQTPYT

SEQ ID NO: 444 - protein, 8 aa, Artificial Sequence
  source: /note="Description of Artificial Sequence: Synthetic peptide"
MQNIQFPS

SEQ ID NO: 445 - protein, 8 aa, Artificial Sequence
  source: /note="Description of Artificial Sequence: Synthetic peptide"
QQSYKRAS

SEQ ID NO: 446 - protein, 9 aa, Artificial Sequence
  source: /note="Description of Artificial Sequence: Synthetic peptide"
MQGRQFPYS

SEQ ID NO: 447 - protein, 8 aa, Artificial Sequence
  source: /note="Description of Artificial Sequence: Synthetic peptide"
QQYGSSLT

SEQ ID NO: 448 - protein, 9 aa, Artificial Sequence
  source: /note="Description of Artificial Sequence: Synthetic peptide"
QQYGSSSWT

SEQ ID NO: 449 - protein, 10 aa, Artificial Sequence
  source: /note="Description of Artificial Sequence: Synthetic peptide"
QQYGSSPPWT

SEQ ID NO: 450 - protein, 7 aa, Artificial Sequence
  source: /note="Description of Artificial Sequence: Synthetic peptide"
QQSYTLA

SEQ ID NO: 451 - protein, 9 aa, Artificial Sequence
  source: /note="Description of Artificial Sequence: Synthetic peptide"
MQGTHWPGT

SEQ ID NO: 452 - protein, 9 aa, Artificial Sequence
  source: /note="Description of Artificial Sequence: Synthetic peptide"
QQYESLPLT

SEQ ID NO: 453 - protein, 10 aa, Artificial Sequence
  source: /note="Description of Artificial Sequence: Synthetic peptide"
QQYNDWLPVT

SEQ ID NO: 454 - protein, 10 aa, Artificial Sequence
  source: /note="Description of Artificial Sequence: Synthetic peptide"
QQYAGSPPFT

SEQ ID NO: 455 - protein, 9 aa, Artificial Sequence
  source: /note="Description of Artificial Sequence: Synthetic peptide"
LQHDNFPLT

SEQ ID NO: 456 - protein, 9 aa, Artificial Sequence
  source: /note="Description of Artificial Sequence: Synthetic peptide"
QHYYRFPYS

SEQ ID NO: 457 - protein, 11 aa, Artificial Sequence
  source: /note="Description of Artificial Sequence: Synthetic peptide"
QVWDSDSEHVV

SEQ ID NO: 458 - protein, 9 aa, Artificial Sequence
  source: /note="Description of Artificial Sequence: Synthetic peptide"
QAWDDTTVV

SEQ ID NO: 459 - protein, 9 aa, Artificial Sequence
  source: /note="Description of Artificial Sequence: Synthetic peptide"
QKYNSAPFT

SEQ ID NO: 460 - protein, 12 aa, Artificial Sequence
  source: /note="Description of Artificial Sequence: Synthetic peptide"
SSRDSSGDHLRV

SEQ ID NO: 461 - protein, 11 aa, Artificial Sequence
  source: /note="Description of Artificial Sequence: Synthetic peptide"
NSRDSSGHHLL

SEQ ID NO: 462 - protein, 14 aa, Artificial Sequence
  source: /note="Description of Artificial Sequence: Synthetic peptide"
QHYGSSFNGSSLFT

SEQ ID NO: 463 - protein, 10 aa, Artificial Sequence
  source: /note="Description of Artificial Sequence: Synthetic peptide"
QQFGTSSGLT

SEQ ID NO: 464 - protein, 9 aa, Artificial Sequence
  source: /note="Description of Artificial Sequence: Synthetic peptide"
QQSYSTPYS

SEQ ID NO: 465 - protein, 10 aa, Artificial Sequence
  source: /note="Description of Artificial Sequence: Synthetic peptide"
QHYESSPSWT

SEQ ID NO: 466 - protein, 10 aa, Artificial Sequence
  source: /note="Description of Artificial Sequence: Synthetic peptide"
QQYGSPPRFT

SEQ ID NO: 467 - protein, 10 aa, Artificial Sequence
  source: /note="Description of Artificial Sequence: Synthetic peptide"
QHYGSSPSWT

SEQ ID NO: 468 - protein, 10 aa, Artificial Sequence
  source: /note="Description of Artificial Sequence: Synthetic peptide"
QHYDSSPSWT

SEQ ID NO: 469 - protein, 10 aa, Artificial Sequence
  source: /note="Description of Artificial Sequence: Synthetic peptide"
QYYGTSPMYT

SEQ ID NO: 470 - protein, 9 aa, Artificial Sequence
  source: /note="Description of Artificial Sequence: Synthetic peptide"
MQALQTPLT

SEQ ID NO: 471 - protein, 11 aa, Artificial Sequence
  source: /note="Description of Artificial Sequence: Synthetic peptide"
QHYGNSPPKFT

SEQ ID NO: 472 - protein, 10 aa, Artificial Sequence
  source: /note="Description of Artificial Sequence: Synthetic peptide"
QHYGGSPRLT

SEQ ID NO: 473 - protein, 9 aa, Artificial Sequence
  source: /note="Description of Artificial Sequence: Synthetic peptide"
QQHYSTPWT

SEQ ID NO: 474 - protein, 9 aa, Artificial Sequence
  source: /note="Description of Artificial Sequence: Synthetic peptide"
LQSRIFPRT

SEQ ID NO: 475 - protein, 9 aa, Artificial Sequence
  source: /note="Description of Artificial Sequence: Synthetic peptide"
LQSRTIPRT

SEQ ID NO: 476 - protein, 7 aa, Artificial Sequence
  source: /note="Description of Artificial Sequence: Synthetic peptide"
SQSISSY

SEQ ID NO: 477 - protein, 8 aa, Artificial Sequence
  source: /note="Description of Artificial Sequence: Synthetic peptide"
SQSISSSF

SEQ ID NO: 478 - protein, 12 aa, Artificial Sequence
  source: /note="Description of Artificial Sequence: Synthetic peptide"
SQSLLHSNGYNY

SEQ ID NO: 479 - protein, 12 aa, Artificial Sequence
  source: /note="Description of Artificial Sequence: Synthetic peptide"
SQSLLRNDGKTP

SEQ ID NO: 480 - protein, 12 aa, Artificial Sequence
  source: /note="Description of Artificial Sequence: Synthetic peptide"
SQSLLYSNGYNY

SEQ ID NO: 481 - protein, 7 aa, Artificial Sequence
  source: /note="Description of Artificial Sequence: Synthetic peptide"
SQSVSSN

SEQ ID NO: 482 - protein, 7 aa, Artificial Sequence
  source: /note="Description of Artificial Sequence: Synthetic peptide"
SQSVSSK

SEQ ID NO: 483 - protein, 8 aa, Artificial Sequence
  source: /note="Description of Artificial Sequence: Synthetic peptide"
SQSVGSTN

SEQ ID NO: 484 - protein, 12 aa, Artificial Sequence
  source: /note="Description of Artificial Sequence: Synthetic peptide"
SESLVHNSGKTY

SEQ ID NO: 485 - protein, 7 aa, Artificial Sequence
  source: /note="Description of Artificial Sequence: Synthetic peptide"
SEDINKF

SEQ ID NO: 486 - protein, 7 aa, Artificial Sequence
  source: /note="Description of Artificial Sequence: Synthetic peptide"
SQSVGSN

SEQ ID NO: 487 - protein, 8 aa, Artificial Sequence
  source: /note="Description of Artificial Sequence: Synthetic peptide"
SQSIGSSS

SEQ ID NO: 488 - protein, 7 aa, Artificial Sequence
  source: /note="Description of Artificial Sequence: Synthetic peptide"
SQDIDDA

SEQ ID NO: 489 - protein, 7 aa, Artificial Sequence
  source: /note="Description of Artificial Sequence: Synthetic peptide"
SQDIYNN

SEQ ID NO: 490 - protein, 7 aa, Artificial Sequence
  source: /note="Description of Artificial Sequence: Synthetic peptide"
NNIGTKS

SEQ ID NO: 491 - protein, 7 aa, Artificial Sequence
  source: /note="Description of Artificial Sequence: Synthetic peptide"
DGLSKKY

SEQ ID NO: 492 - protein, 7 aa, Artificial Sequence
  source: /note="Description of Artificial Sequence: Synthetic peptide"
SQGIRNW

SEQ ID NO: 493 - protein, 7 aa, Artificial Sequence
  source: /note="Description of Artificial Sequence: Synthetic peptide"
NNIGSKS

SEQ ID NO: 494 - protein, 7 aa, Artificial Sequence
  source: /note="Description of Artificial Sequence: Synthetic peptide"
DSLGNYY

SEQ ID NO: 495 - protein, 8 aa, Artificial Sequence
  source: /note="Description of Artificial Sequence: Synthetic peptide"
SQSVSSAY

SEQ ID NO: 496 - protein, 7 aa, Artificial Sequence
  source: /note="Description of Artificial Sequence: Synthetic peptide"
SQSVSNS

SEQ ID NO: 497 - protein, 8 aa, Artificial Sequence
  source: /note="Description of Artificial Sequence: Synthetic peptide"
SQSVSSSF

SEQ ID NO: 498 - protein, 8 aa, Artificial Sequence
  source: /note="Description of Artificial Sequence: Synthetic peptide"
SQSVSTTF

SEQ ID NO: 499 - protein, 8 aa, Artificial Sequence
  source: /note="Description of Artificial Sequence: Synthetic peptide"
TQSIGSSF

SEQ ID NO: 500 - protein, 8 aa, Artificial Sequence
  source: /note="Description of Artificial Sequence: Synthetic peptide"
SQSVSSSY

SEQ ID NO: 501 - protein, 8 aa, Artificial Sequence
  source: /note="Description of Artificial Sequence: Synthetic peptide"
SQRVASNY

SEQ ID NO: 502 - protein, 8 aa, Artificial Sequence
  source: /note="Description of Artificial Sequence: Synthetic peptide"
SQSLSSNF

SEQ ID NO: 503 - protein, 8 aa, Artificial Sequence
  source: /note="Description of Artificial Sequence: Synthetic peptide"
SQSVASSF

SEQ ID NO: 504 - protein, 7 aa, Artificial Sequence
  source: /note="Description of Artificial Sequence: Synthetic peptide"
SQDVNTA

SEQ ID NO: 505 - protein, 11 aa, Artificial Sequence
  source: /note="Description of Artificial Sequence: Synthetic peptide"
SESVSVIGAHL

SEQ ID NO: 506 - protein, 11 aa, Artificial Sequence
  source: /note="Description of Artificial Sequence: Synthetic peptide"
SESVTILGSHL

SEQ ID NO: 507 - protein, 3 aa, Artificial Sequence
  source: /note="Description of Artificial Sequence: Synthetic peptide"
AAS

SEQ ID NO: 508 - protein, 3 aa, Artificial Sequence
  source: /note="Description of Artificial Sequence: Synthetic peptide"
GAS

SEQ ID NO: 509 - protein, 3 aa, Artificial Sequence
  source: /note="Description of Artificial Sequence: Synthetic peptide"
LGS

SEQ ID NO: 510 - protein, 3 aa, Artificial Sequence
  source: /note="Description of Artificial Sequence: Synthetic peptide"
EVS

SEQ ID NO: 511 - protein, 3 aa, Artificial Sequence
  source: /note="Description of Artificial Sequence: Synthetic peptide"
SAT

SEQ ID NO: 512 - protein, 3 aa, Artificial Sequence
  source: /note="Description of Artificial Sequence: Synthetic peptide"
AAN

SEQ ID NO: 513 - protein, 3 aa, Artificial Sequence
  source: /note="Description of Artificial Sequence: Synthetic peptide"
DDS

SEQ ID NO: 514 - protein, 3 aa, Artificial Sequence
  source: /note="Description of Artificial Sequence: Synthetic peptide"
RDK

SEQ ID NO: 515 - protein, 3 aa, Artificial Sequence
  source: /note="Description of Artificial Sequence: Synthetic peptide"
GKN

SEQ ID NO: 516 - protein, 3 aa, Artificial Sequence
  source: /note="Description of Artificial Sequence: Synthetic peptide"
GSS

SEQ ID NO: 517 - protein, 3 aa, Artificial Sequence
  source: /note="Description of Artificial Sequence: Synthetic peptide"
GTS

SEQ ID NO: 518 - protein, 3 aa, Artificial Sequence
  source: /note="Description of Artificial Sequence: Synthetic peptide"
SAS

SEQ ID NO: 519 - protein, 3 aa, Artificial Sequence
  source: /note="Description of Artificial Sequence: Synthetic peptide"
LAS

SEQ ID NO: 520 - protein, 6 aa, Artificial Sequence
  source: /note="Description of Artificial Sequence: Synthetic peptide"
SYSTPY

SEQ ID NO: 521 - protein, 7 aa, Artificial Sequence
  source: /note="Description of Artificial Sequence: Synthetic peptide"
YHSSPSW

SEQ ID NO: 522 - protein, 6 aa, Artificial Sequence
  source: /note="Description of Artificial Sequence: Synthetic peptide"
ALQTPY

SEQ ID NO: 523 - protein, 5 aa, Artificial Sequence
  source: /note="Description of Artificial Sequence: Synthetic peptide"
NIQFP

SEQ ID NO: 524 - protein, 5 aa, Artificial Sequence
  source: /note="Description of Artificial Sequence: Synthetic peptide"
SYKRA

SEQ ID NO: 525 - protein, 6 aa, Artificial Sequence
  source: /note="Description of Artificial Sequence: Synthetic peptide"
GRQFPY

SEQ ID NO: 526 - protein, 5 aa, Artificial Sequence
  source: /note="Description of Artificial Sequence: Synthetic peptide"
YGSSL

SEQ ID NO: 527 - protein, 6 aa, Artificial Sequence
  source: /note="Description of Artificial Sequence: Synthetic peptide"
YGSSSW

SEQ ID NO: 528 - protein, 7 aa, Artificial Sequence
  source: /note="Description of Artificial Sequence: Synthetic peptide"
YGSSPPW

SEQ ID NO: 529 - protein, 4 aa, Artificial Sequence
  source: /note="Description of Artificial Sequence: Synthetic peptide"
SYTL

SEQ ID NO: 530 - protein, 6 aa, Artificial Sequence
  source: /note="Description of Artificial Sequence: Synthetic peptide"
GTHWPG

SEQ ID NO: 531 - protein, 6 aa, Artificial Sequence
  source: /note="Description of Artificial Sequence: Synthetic peptide"
YESLPL

SEQ ID NO: 532 - protein, 7 aa, Artificial Sequence
  source: /note="Description of Artificial Sequence: Synthetic peptide"
YNDWLPV

SEQ ID NO: 533 - protein, 7 aa, Artificial Sequence
  source: /note="Description of Artificial Sequence: Synthetic peptide"
YAGSPPF

SEQ ID NO: 534 - protein, 6 aa, Artificial Sequence
  source: /note="Description of Artificial Sequence: Synthetic peptide"
HDNFPL

SEQ ID NO: 535 - protein, 6 aa, Artificial Sequence
  source: /note="Description of Artificial Sequence: Synthetic peptide"
YYRFPY

SEQ ID NO: 536 - protein, 8 aa, Artificial Sequence
  source: /note="Description of Artificial Sequence: Synthetic peptide"
WDSDSEHV

SEQ ID NO: 537 - protein, 6 aa, Artificial Sequence
  source: /note="Description of Artificial Sequence: Synthetic peptide"
WDDTTV

SEQ ID NO: 538 - protein, 6 aa, Artificial Sequence
  source: /note="Description of Artificial Sequence: Synthetic peptide"
YNSAPF

SEQ ID NO: 539 - protein, 9 aa, Artificial Sequence
  source: /note="Description of Artificial Sequence: Synthetic peptide"
RDSSGDHLR

SEQ ID NO: 540 - protein, 8 aa, Artificial Sequence
  source: /note="Description of Artificial Sequence: Synthetic peptide"
RDSSGHHL

SEQ ID NO: 541 - protein, 11 aa, Artificial Sequence
  source: /note="Description of Artificial Sequence: Synthetic peptide"
YGSSFNGSSLF

SEQ ID NO: 542 - protein, 7 aa, Artificial Sequence
  source: /note="Description of Artificial Sequence: Synthetic peptide"
FGTSSGL

SEQ ID NO: 543 - protein, 7 aa, Artificial Sequence
  source: /note="Description of Artificial Sequence: Synthetic peptide"
YESSPSW

SEQ ID NO: 544 - protein, 7 aa, Artificial Sequence
  source: /note="Description of Artificial Sequence: Synthetic peptide"
YGSPPRF

SEQ ID NO: 545 - protein, 7 aa, Artificial Sequence
  source: /note="Description of Artificial Sequence: Synthetic peptide"
YGSSPSW

SEQ ID NO: 546 - protein, 7 aa, Artificial Sequence
  source: /note="Description of Artificial Sequence: Synthetic peptide"
YDSSPSW

SEQ ID NO: 547 - protein, 7 aa, Artificial Sequence
  source: /note="Description of Artificial Sequence: Synthetic peptide"
YGTSPMY

SEQ ID NO: 548 - protein, 6 aa, Artificial Sequence
  source: /note="Description of Artificial Sequence: Synthetic peptide"
ALQTPL

SEQ ID NO: 549 - protein, 8 aa, Artificial Sequence
  source: /note="Description of Artificial Sequence: Synthetic peptide"
YGNSPPKF

SEQ ID NO: 550 - protein, 7 aa, Artificial Sequence
  source: /note="Description of Artificial Sequence: Synthetic peptide"
YGGSPRL

SEQ ID NO: 551 - protein, 6 aa, Artificial Sequence
  source: /note="Description of Artificial Sequence: Synthetic peptide"
HYSTPW

SEQ ID NO: 552 - protein, 6 aa, Artificial Sequence
  source: /note="Description of Artificial Sequence: Synthetic peptide"
SRIFPR

SEQ ID NO: 553 - protein, 6 aa, Artificial Sequence
  source: /note="Description of Artificial Sequence: Synthetic peptide"
SRTIPR

SEQ ID NO: 554 - protein, 5 aa, Artificial Sequence
  source: /note="Description of Artificial Sequence: Synthetic peptide"
NHGMS

SEQ ID NO: 555 - protein, 5 aa, Artificial Sequence
  source: /note="Description of Artificial Sequence: Synthetic peptide"
NYAMS

SEQ ID NO: 556 - protein, 5 aa, Artificial Sequence
  source: /note="Description of Artificial Sequence: Synthetic peptide"
DYAMH

SEQ ID NO: 557 - protein, 5 aa, Artificial Sequence
  source: /note="Description of Artificial Sequence: Synthetic peptide"
NFGIN

SEQ ID NO: 558 - protein, 5 aa, Artificial Sequence
  source: /note="Description of Artificial Sequence: Synthetic peptide"
SDAMT

SEQ ID NO: 559 - protein, 5 aa, Artificial Sequence
  source: /note="Description of Artificial Sequence: Synthetic peptide"
NYGIT

SEQ ID NO: 560 - protein, 5 aa, Artificial Sequence
  source: /note="Description of Artificial Sequence: Synthetic peptide"
DYYMS

SEQ ID NO: 561 - protein, 7 aa, Artificial Sequence
  source: /note="Description of Artificial Sequence: Synthetic peptide"
SSYYYWG

SEQ ID NO: 562 - protein, 7 aa, Artificial Sequence
  source: /note="Description of Artificial Sequence: Synthetic peptide"
TSGMCVS

SEQ ID NO: 563 - protein, 5 aa, Artificial Sequence
  source: /note="Description of Artificial Sequence: Synthetic peptide"
SYSMN

SEQ ID NO: 564 - protein, 5 aa, Artificial Sequence
  source: /note="Description of Artificial Sequence: Synthetic peptide"
SHYIH

SEQ ID NO: 565 - protein, 7 aa, Artificial Sequence
  source: /note="Description of Artificial Sequence: Synthetic peptide"
SGGYYWS

SEQ ID NO: 566 - protein, 5 aa, Artificial Sequence
  source: /note="Description of Artificial Sequence: Synthetic peptide"
SYAIS

SEQ ID NO: 567 - protein, 7 aa, Artificial Sequence
  source: /note="Description of Artificial Sequence: Synthetic peptide"
SNSAAWN

SEQ ID NO: 568 - protein, 5 aa, Artificial Sequence
  source: /note="Description of Artificial Sequence: Synthetic peptide"
SYAMS

SEQ ID NO: 569 - protein, 5 aa, Artificial Sequence
  source: /note="Description of Artificial Sequence: Synthetic peptide"
RYPMS

SEQ ID NO: 570 - protein, 5 aa, Artificial Sequence
  source: /note="Description of Artificial Sequence: Synthetic peptide"
NFGMN

SEQ ID NO: 571 - protein, 5 aa, Artificial Sequence
  source: /note="Description of Artificial Sequence: Synthetic peptide"
DYSIN

SEQ ID NO: 572 - protein, 5 aa, Artificial Sequence
  source: /note="Description of Artificial Sequence: Synthetic peptide"
HYSMN

SEQ ID NO: 573 - protein, 16 aa, Artificial Sequence
  source: /note="Description of Artificial Sequence: Synthetic peptide"
GIVYSGSTYYAASVKG

SEQ ID NO: 574 - protein, 17 aa, Artificial Sequence
  source: /note="Description of Artificial Sequence: Synthetic peptide"
GISRSGENTYYADSVKG

SEQ ID NO: 575 - protein, 17 aa, Artificial Sequence
  source: /note="Description of Artificial Sequence: Synthetic peptide"
GISWNSGSIGYADSVKG

SEQ ID NO: 576 - protein, 17 aa, Artificial Sequence
  source: /note="Description of Artificial Sequence: Synthetic peptide"
WINPKNNNTNYAQKFQG

SEQ ID NO: 577 - protein, 17 aa, Artificial Sequence
  source: /note="Description of Artificial Sequence: Synthetic peptide"
VISGSGGTTYYADSVKG

SEQ ID NO: 578 - protein, 17 aa, Artificial Sequence
  source: /note="Description of Artificial Sequence: Synthetic peptide"
WISAYNGNTNYAQKFQG

SEQ ID NO: 579 - protein, 17 aa, Artificial Sequence
  source: /note="Description of Artificial Sequence: Synthetic peptide"
YISSSGSTIYYADSVKG

SEQ ID NO: 580 - protein, 17 aa, Artificial Sequence
  source: /note="Description of Artificial Sequence: Synthetic peptide"
YISSSGNTIYYADSVKG

SEQ ID NO: 581 - protein, 16 aa, Artificial Sequence
  source: /note="Description of Artificial Sequence: Synthetic peptide"
SIYYSGSAYYNPSLKS

SEQ ID NO: 582 - protein, 16 aa, Artificial Sequence
  source: /note="Description of Artificial Sequence: Synthetic peptide"
RIDWDEDKFYSTSLKT

SEQ ID NO: 583 - protein, 17 aa, Artificial Sequence
  source: /note="Description of Artificial Sequence: Synthetic peptide"
SISSSSSYIYYADSVKG

SEQ ID NO: 584 - protein, 17 aa, Artificial Sequence
  source: /note="Description of Artificial Sequence: Synthetic peptide"
MINPSGGVTAYSQTLQG

SEQ ID NO: 585 - protein, 16 aa, Artificial Sequence
  source: /note="Description of Artificial Sequence: Synthetic peptide"
YIYYSGSTYYNPSLKS

SEQ ID NO: 586 - protein, 17 aa, Artificial Sequence
  source: /note="Description of Artificial Sequence: Synthetic peptide"
GIIPIFGTANYAQKFQG

SEQ ID NO: 587 - protein, 18 aa, Artificial Sequence
  source: /note="Description of Artificial Sequence: Synthetic peptide"
RTYYRSKWYSFYAISLKS

SEQ ID NO: 588 - protein, 17 aa, Artificial Sequence
  source: /note="Description of Artificial Sequence: Synthetic peptide"
AISGSGGSTYYADSVKG

SEQ ID NO: 589 - protein, 17 aa, Artificial Sequence
  source: /note="Description of Artificial Sequence: Synthetic peptide"
GISDSGVSTYYADSAKG

SEQ ID NO: 590 - protein, 17 aa, Artificial Sequence
  source: /note="Description of Artificial Sequence: Synthetic peptide"
SINWKGNSLAYGDSVKG

SEQ ID NO: 591 - protein, 17 aa, Artificial Sequence
  source: /note="Description of Artificial Sequence: Synthetic peptide"
WINTYTGESYFADDFKG

SEQ ID NO: 592 - protein, 17 aa, Artificial Sequence
  source: /note="Description of Artificial Sequence: Synthetic peptide"
WINTETREPAYAYDFRG

SEQ ID NO: 593 - protein, 17 aa, Artificial Sequence
  source: /note="Description of Artificial Sequence: Synthetic peptide"
RINTESGVPIYADDFKG

SEQ ID NO: 594 - protein, 17 aa, Artificial Sequence
  source: /note="Description of Artificial Sequence: Synthetic peptide"
RINTETGEPLYADDFKG

SEQ ID NO: 595 - protein, 7 aa, Artificial Sequence
  source: /note="Description of Artificial Sequence: Synthetic peptide"
HGGESDV

SEQ ID NO: 596 - protein, 11 aa, Artificial Sequence
  source: /note="Description of Artificial Sequence: Synthetic peptide"
SPAHYYGGMDV

SEQ ID NO: 597 - protein, 6 aa, Artificial Sequence
  source: /note="Description of Artificial Sequence: Synthetic peptide"
HSFLAY

SEQ ID NO: 598 - protein, 11 aa, Artificial Sequence
  source: /note="Description of Artificial Sequence: Synthetic peptide"
GPYYYQSYMDV

SEQ ID NO: 599 - protein, 14 aa, Artificial Sequence
  source: /note="Description of Artificial Sequence: Synthetic peptide"
LDSSGYYYARGPRY

SEQ ID NO: 600 - protein, 9 aa, Artificial Sequence
  source: /note="Description of Artificial Sequence: Synthetic peptide"
GPYYYYMDV

SEQ ID NO: 601 - protein, 8 aa, Artificial Sequence
  source: /note="Description of Artificial Sequence: Synthetic peptide"
ESGDGMDV

SEQ ID NO: 602 - protein, 8 aa, Artificial Sequence
  source: /note="Description of Artificial Sequence: Synthetic peptide"
STMVREDY

SEQ ID NO: 603 - protein, 11 aa, Artificial Sequence
  source: /note="Description of Artificial Sequence: Synthetic peptide"
HWQEWPDAFDI

SEQ ID NO: 604 - protein, 13 aa, Artificial Sequence
  source: /note="Description of Artificial Sequence: Synthetic peptide"
SGAGGTSATAFDI

SEQ ID NO: 605 - protein, 10 aa, Artificial Sequence
  source: /note="Description of Artificial Sequence: Synthetic peptide"
TIAAVYAFDI

SEQ ID NO: 606 - protein, 8 aa, Artificial Sequence
  source: /note="Description of Artificial Sequence: Synthetic peptide"
DLRGAFDI

SEQ ID NO: 607 - protein, 11 aa, Artificial Sequence
  source: /note="Description of Artificial Sequence: Synthetic peptide"
EGSGSGWYFDF

SEQ ID NO: 608 - protein, 13 aa, Artificial Sequence
  source: /note="Description of Artificial Sequence: Synthetic peptide"
AGIAARLRGAFDI

SEQ ID NO: 609 - protein, 20 aa, Artificial Sequence
  source: /note="Description of Artificial Sequence: Synthetic peptide"
RGGYQLLRWDVGLLRSAFDI

SEQ ID NO: 610 - protein, 13 aa, Artificial Sequence
  source: /note="Description of Artificial Sequence: Synthetic peptide"
SSPEGLFLYWFDP

SEQ ID NO: 611 - protein, 9 aa, Artificial Sequence
  source: /note="Description of Artificial Sequence: Synthetic peptide"
VEGSGSLDY

SEQ ID NO: 612 - protein, 9 aa, Artificial Sequence
  source: /note="Description of Artificial Sequence: Synthetic peptide"
RAGSEASDI

SEQ ID NO: 613 - protein, 15 aa, Artificial Sequence
  source: /note="Description of Artificial Sequence: Synthetic peptide"
ATYKRELRYYYGMDV

SEQ ID NO: 614 - protein, 8 aa, Artificial Sequence
  source: /note="Description of Artificial Sequence: Synthetic peptide"
VGKAVPDV

SEQ ID NO: 615 - protein, 13 aa, Artificial Sequence
  source: /note="Description of Artificial Sequence: Synthetic peptide"
HQGVAYYNYAMDV

SEQ ID NO: 616 - protein, 8 aa, Artificial Sequence
  source: /note="Description of Artificial Sequence: Synthetic peptide"
VVRDGMDV

SEQ ID NO: 617 - protein, 9 aa, Artificial Sequence
  source: /note="Description of Artificial Sequence: Synthetic peptide"
IPQTGTFDY

SEQ ID NO: 618 - protein, 15 aa, Artificial Sequence
  source: /note="Description of Artificial Sequence: Synthetic peptide"
ANYKRELRYYYGMDV

SEQ ID NO: 619 - protein, 11 aa, Artificial Sequence
  source: /note="Description of Artificial Sequence: Synthetic peptide"
ALVGATGAFDI

SEQ ID NO: 620 - protein, 8 aa, Artificial Sequence
  source: /note="Description of Artificial Sequence: Synthetic peptide"
WFGEGFDP

SEQ ID NO: 621 - protein, 17 aa, Artificial Sequence
  source: /note="Description of Artificial Sequence: Synthetic peptide"
VGYDSSGYYRDYYGMDV

SEQ ID NO: 622 - protein, 13 aa, Artificial Sequence
  source: /note="Description of Artificial Sequence: Synthetic peptide"
MGWSSGYLGAFDI

SEQ ID NO: 623 - protein, 13 aa, Artificial Sequence
  source: /note="Description of Artificial Sequence: Synthetic peptide"
GEIYYGYDGGFAY

SEQ ID NO: 624 - protein, 8 aa, Artificial Sequence
  source: /note="Description of Artificial Sequence: Synthetic peptide"
DYSYAMDY

SEQ ID NO: 625 - protein, 8 aa, Artificial Sequence
  source: /note="Description of Artificial Sequence: Synthetic peptide"
DYLYSLDF

SEQ ID NO: 626 - protein, 8 aa, Artificial Sequence
  source: /note="Description of Artificial Sequence: Synthetic peptide"
DYLYSCDY

SEQ ID NO: 627 - protein, 7 aa, Artificial Sequence
  source: /note="Description of Artificial Sequence: Synthetic peptide"
GFALSNH

SEQ ID NO: 628 - protein, 7 aa, Artificial Sequence
  source: /note="Description of Artificial Sequence: Synthetic peptide"
GFTFSNY

SEQ ID NO: 629 - protein, 7 aa, Artificial Sequence
  source: /note="Description of Artificial Sequence: Synthetic peptide"
GFTFDDY

SEQ ID NO: 630 - protein, 7 aa, Artificial Sequence
  source: /note="Description of Artificial Sequence: Synthetic peptide"
GYIFDNF

SEQ ID NO: 631 - protein, 7 aa, Artificial Sequence
  source: /note="Description of Artificial Sequence: Synthetic peptide"
GFTFSSD

SEQ ID NO: 632 - protein, 7 aa, Artificial Sequence
  source: /note="Description of Artificial Sequence: Synthetic peptide"
GYTFSNY

SEQ ID NO: 633 - protein, 7 aa, Artificial Sequence
  source: /note="Description of Artificial Sequence: Synthetic peptide"
GFTFSDY

SEQ ID NO: 634 - protein, 9 aa, Artificial Sequence
  source: /note="Description of Artificial Sequence: Synthetic peptide"
GGSISSSYY

SEQ ID NO: 635 - protein, 9 aa, Artificial Sequence
  source: /note="Description of Artificial Sequence: Synthetic peptide"
GFSLRTSGM

SEQ ID NO: 636 - protein, 7 aa, Artificial Sequence
  source: /note="Description of Artificial Sequence: Synthetic peptide"
GFTFSSY

SEQ ID NO: 637 - protein, 7 aa, Artificial Sequence
  source: /note="Description of Artificial Sequence: Synthetic peptide"
GYTVTSH

SEQ ID NO: 638 - protein, 9 aa, Artificial Sequence
  source: /note="Description of Artificial Sequence: Synthetic peptide"
GGSISSGGY

SEQ ID NO: 639 - protein, 7 aa, Artificial Sequence
  source: /note="Description of Artificial Sequence: Synthetic peptide"
GGTFSSY

SEQ ID NO: 640 - protein, 9 aa, Artificial Sequence
  source: /note="Description of Artificial Sequence: Synthetic peptide"
GDSVSSNSA

SEQ ID NO: 641 - protein, 7 aa, Artificial Sequence
  source: /note="Description of Artificial Sequence: Synthetic peptide"
GITFSRY

SEQ ID NO: 642 - protein, 7 aa, Artificial Sequence
  source: /note="Description of Artificial Sequence: Synthetic peptide"
GFSFSSY

SEQ ID NO: 643 - protein, 7 aa, Artificial Sequence
  source: /note="Description of Artificial Sequence: Synthetic peptide"
GYTFTNF

SEQ ID NO: 644 - protein, 7 aa, Artificial Sequence
  source: /note="Description of Artificial Sequence: Synthetic peptide"
GYTFTDY

SEQ ID NO: 645 - protein, 7 aa, Artificial Sequence
  source: /note="Description of Artificial Sequence: Synthetic peptide"
GYTFRHY

SEQ ID NO: 646 - protein, 7 aa, Artificial Sequence
  source: /note="Description of Artificial Sequence: Synthetic peptide"
GYTFTHY

SEQ ID NO: 647 - protein, 5 aa, Artificial Sequence
  source: /note="Description of Artificial Sequence: Synthetic peptide"
VYSGS

SEQ ID NO: 648 - protein, 6 aa, Artificial Sequence
  source: /note="Description of Artificial Sequence: Synthetic peptide"
SRSGEN

SEQ ID NO: 649 - protein, 6 aa, Artificial Sequence
  source: /note="Description of Artificial Sequence: Synthetic peptide"
SWNSGS

SEQ ID NO: 650 - protein, 6 aa, Artificial Sequence
  source: /note="Description of Artificial Sequence: Synthetic peptide"
NPKNNN

SEQ ID NO: 651 - protein, 6 aa, Artificial Sequence
  source: /note="Description of Artificial Sequence: Synthetic peptide"
SGSGGT

SEQ ID NO: 652 - protein, 6 aa, Artificial Sequence
  source: /note="Description of Artificial Sequence: Synthetic peptide"
SAYNGN

SEQ ID NO: 653 - protein, 6 aa, Artificial Sequence
  source: /note="Description of Artificial Sequence: Synthetic peptide"
SSSGST

SEQ ID NO: 654 - protein, 6 aa, Artificial Sequence
  source: /note="Description of Artificial Sequence: Synthetic peptide"
SSSGNT

SEQ ID NO: 655 - protein, 5 aa, Artificial Sequence
  source: /note="Description of Artificial Sequence: Synthetic peptide"
YYSGS

SEQ ID NO: 656 - protein, 5 aa, Artificial Sequence
  source: /note="Description of Artificial Sequence: Synthetic peptide"
DWDED

SEQ ID NO: 657 - protein, 6 aa, Artificial Sequence
  source: /note="Description of Artificial Sequence: Synthetic peptide"
SSSSSY

SEQ ID NO: 658 - protein, 6 aa, Artificial Sequence
  source: /note="Description of Artificial Sequence: Synthetic peptide"
NPSGGV

SEQ ID NO: 659 - protein, 6 aa, Artificial Sequence
  source: /note="Description of Artificial Sequence: Synthetic peptide"
IPIFGT

SEQ ID NO: 660 - protein, 7 aa, Artificial Sequence
  source: /note="Description of Artificial Sequence: Synthetic peptide"
YYRSKWY

SEQ ID NO: 661 - protein, 6 aa, Artificial Sequence
  source: /note="Description of Artificial Sequence: Synthetic peptide"
SGSGGS

SEQ ID NO: 662 - protein, 6 aa, Artificial Sequence
  source: /note="Description of Artificial Sequence: Synthetic peptide"
SDSGVS

SEQ ID NO: 663 - protein, 6 aa, Artificial Sequence
  source: /note="Description of Artificial Sequence: Synthetic peptide"
NWKGNS

SEQ ID NO: 664 - protein, 6 aa, Artificial Sequence
  source: /note="Description of Artificial Sequence: Synthetic peptide"
NTYTGE

SEQ ID NO: 665 - protein, 6 aa, Artificial Sequence
  source: /note="Description of Artificial Sequence: Synthetic peptide"
NTETRE

SEQ ID NO: 666 - protein, 6 aa, Artificial Sequence
  source: /note="Description of Artificial Sequence: Synthetic peptide"
NTESGV

SEQ ID NO: 667 - protein, 6 aa, Artificial Sequence
  source: /note="Description of Artificial Sequence: Synthetic peptide"
NTETGE

SEQ ID NO: 668 - protein, 10 aa, Artificial Sequence
  source: /note="Description of Artificial Sequence: Synthetic peptide"
GFALSNHGMS

SEQ ID NO: 669 - protein, 10 aa, Artificial Sequence
  source: /note="Description of Artificial Sequence: Synthetic peptide"
GFTFSNYAMS

SEQ ID NO: 670 - protein, 10 aa, Artificial Sequence
  source: /note="Description of Artificial Sequence: Synthetic peptide"
GFTFDDYAMH

SEQ ID NO: 671 - protein, 10 aa, Artificial Sequence
  source: /note="Description of Artificial Sequence: Synthetic peptide"
GYIFDNFGIN

SEQ ID NO: 672 - protein, 10 aa, Artificial Sequence
  source: /note="Description of Artificial Sequence: Synthetic peptide"
GFTFSSDAMT

SEQ ID NO: 673 - protein, 10 aa, Artificial Sequence
  source: /note="Description of Artificial Sequence: Synthetic peptide"
GYTFSNYGIT

SEQ ID NO: 674 - protein, 10 aa, Artificial Sequence
  source: /note="Description of Artificial Sequence: Synthetic peptide"
GFTFSDYYMS

SEQ ID NO: 675 - protein, 12 aa, Artificial Sequence
  source: /note="Description of Artificial Sequence: Synthetic peptide"
GGSISSSYYYWG

SEQ ID NO: 676 - protein, 12 aa, Artificial Sequence
  source: /note="Description of Artificial Sequence: Synthetic peptide"
GFSLRTSGMCVS

SEQ ID NO: 677 - protein, 10 aa, Artificial Sequence
  source: /note="Description of Artificial Sequence: Synthetic peptide"
GFTFSSYSMN

SEQ ID NO: 678 - protein, 10 aa, Artificial Sequence
  source: /note="Description of Artificial Sequence: Synthetic peptide"
GYTVTSHYIH

SEQ ID NO: 679 - protein, 12 aa, Artificial Sequence
  source: /note="Description of Artificial Sequence: Synthetic peptide"
GGSISSGGYYWS

SEQ ID NO: 680 - protein, 10 aa, Artificial Sequence
  source: /note="Description of Artificial Sequence: Synthetic peptide"
GGTFSSYAIS

SEQ ID NO: 681 - protein, 12 aa, Artificial Sequence
  source: /note="Description of Artificial Sequence: Synthetic peptide"
GDSVSSNSAAWN

SEQ ID NO: 682 - protein, 10 aa, Artificial Sequence
  source: /note="Description of Artificial Sequence: Synthetic peptide"
GFTFSSYAMS

SEQ ID NO: 683 - protein, 10 aa, Artificial Sequence
  source: /note="Description of Artificial Sequence: Synthetic peptide"
GITFSRYPMS

SEQ ID NO: 684 - protein, 10 aa, Artificial Sequence
  source: /note="Description of Artificial Sequence: Synthetic peptide"
GFSFSSYAMS

SEQ ID NO: 685 - protein, 10 aa, Artificial Sequence
  source: /note="Description of Artificial Sequence: Synthetic peptide"
GYTFTNFGMN

SEQ ID NO: 686 - protein, 10 aa, Artificial Sequence
  source: /note="Description of Artificial Sequence: Synthetic peptide"
GYTFTDYSIN

SEQ ID NO: 687 - protein, 10 aa, Artificial Sequence
  source: /note="Description of Artificial Sequence: Synthetic peptide"
GYTFRHYSMN

SEQ ID NO: 688 - protein, 10 aa, Artificial Sequence
  source: /note="Description of Artificial Sequence: Synthetic peptide"
GYTFTHYSMN

SEQ ID NO: 689 - protein, 5 aa, Artificial Sequence
  source: /note="Description of Artificial Sequence: Synthetic peptide"
DYGVS

SEQ ID NO: 690 - protein, 16 aa, Artificial Sequence
  source: /note="Description of Artificial Sequence: Synthetic peptide"
VIWGSETTYYNSALKS

SEQ ID NO: 691 - protein, 16 aa, Artificial Sequence
  source: /note="Description of Artificial Sequence: Synthetic peptide"
VIWGSETTYYSSSLKS

SEQ ID NO: 692 - protein, 16 aa, Artificial Sequence
  source: /note="Description of Artificial Sequence: Synthetic peptide"
VIWGSETTYYQSSLKS

SEQ ID NO: 693 - protein, 16 aa, Artificial Sequence
  source: /note="Description of Artificial Sequence: Synthetic peptide"
VIWGSETTYYNSSLKS

SEQ ID NO: 694 - protein, 12 aa, Artificial Sequence
  source: /note="Description of Artificial Sequence: Synthetic peptide"
HYYYGGSYAMDY

SEQ ID NO: 695 - protein, 11 aa, Artificial Sequence
  source: /note="Description of Artificial Sequence: Synthetic peptide"
RASQDISKYLN

SEQ ID NO: 696 - protein, 7 aa, Artificial Sequence
  source: /note="Description of Artificial Sequence: Synthetic peptide"
HTSRLHS

SEQ ID NO: 697 - protein, 9 aa, Artificial Sequence
  source: /note="Description of Artificial Sequence: Synthetic peptide"
QQGNTLPYT

SEQ ID NO: 698 - protein, 120 aa, Artificial Sequence
  source: /note="Description of Artificial Sequence: Synthetic polypeptide"
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 699 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 700 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 701 - protein, 120 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 702 - protein, 107 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 703 - protein, 107 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 704 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 705 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 706 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 707 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 708 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 709 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 710 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 711 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 712 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 713 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 714 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 715 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 716 - protein, 6 aa, Artificial Sequence
  source: /note="Description of Artificial Sequence: Synthetic 6xHis tag"
HHHHHH

SEQ ID NO: 717 - protein, 15 aa, Artificial Sequence
  source: /note="Description of Artificial Sequence: Synthetic peptide"
GGGGSGGGGSGGGGS

SEQ ID NO: 718 - protein, 19 aa, Homo sapiens
VPSTPPTPSPSTPPTPSPS

SEQ ID NO: 719 - protein, 6 aa, Homo sapiens
VPPPPP

SEQ ID NO: 720 - protein, 58 aa, Homo sapiens
ESPKAQASSVPTAQPQAEGSLAKATTAPATTRNTGRGGEEKKKEKEKEEQEERETKTP

SEQ ID NO: 721 - protein, 15 aa, Homo sapiens
EPKSCDKTHTCPPCP

SEQ ID NO: 722 - protein, 12 aa, Homo sapiens
ERKCCVECPPCP

SEQ ID NO: 723 - protein, 62 aa, Homo sapiens
ELKTPLGDTTHTCPRCPEPKSCDTPPPCPRCPEPKSCDTPPPCPRCPEPKSCDTPPPCPRCP

SEQ ID NO: 724 - protein, 12 aa, Homo sapiens
ESKYGPPCPSCP

SEQ ID NO: 725 - protein, 12 aa, Homo sapiens
ESKYGPPCPPCP

SEQ ID NO: 726 - protein, 4 aa, Artificial Sequence
  source: /note="Description of Artificial Sequence: Synthetic peptide"
CPPC

SEQ ID NO: 727 - protein, 4 aa, Artificial Sequence
  source: /note="Description of Artificial Sequence: Synthetic peptide"
CPSC

SEQ ID NO: 728 - protein, 4 aa, Artificial Sequence
  source: /note="Description of Artificial Sequence: Synthetic peptide"
CPRC

SEQ ID NO: 729 - protein, 4 aa, Artificial Sequence
  source: /note="Description of Artificial Sequence: Synthetic peptide"
SPPC

SEQ ID NO: 730 - protein, 4 aa, Artificial Sequence
  source: /note="Description of Artificial Sequence: Synthetic peptide"
CPPS

SEQ ID NO: 731 - protein, 4 aa, Artificial Sequence
  source: /note="Description of Artificial Sequence: Synthetic peptide"
SPPS

SEQ ID NO: 732 - protein, 8 aa, Artificial Sequence
  source: /note="Description of Artificial Sequence: Synthetic peptide"
DKTHTCAA

SEQ ID NO: 733 - protein, 11 aa, Artificial Sequence
  source: /note="Description of Artificial Sequence: Synthetic peptide"
DKTHTCPPCPA

SEQ ID NO: 734 - protein, 18 aa, Artificial Sequence
  source: /note="Description of Artificial Sequence: Synthetic peptide"
DKTHTCPPCPATCPPCPA

SEQ ID NO: 735 - protein, 25 aa, Artificial Sequence
  source: /note="Description of Artificial Sequence: Synthetic peptide"
DKTHTCPPCPATCPPCPATCPPCPA

SEQ ID NO: 736 - protein, 30 aa, Artificial Sequence
  source: /note="Description of Artificial Sequence: Synthetic polypeptide"
DKTHTCPPCPAGKPTLYNSLVMSDTAGTCY

SEQ ID NO: 737 - protein, 31 aa, Artificial Sequence
  source: /note="Description of Artificial Sequence: Synthetic polypeptide"
DKTHTCPPCPAGKPTHVNVSVVMAEVDGTCY

SEQ ID NO: 738 - protein, 15 aa, Artificial Sequence
  source: /note="Description of Artificial Sequence: Synthetic peptide"
DKTHTCCVECPPCPA

SEQ ID NO: 739 - protein, 26 aa, Artificial Sequence
  source: /note="Description of Artificial Sequence: Synthetic peptide"
DKTHTCPRCPEPKSCDTPPPCPRCPA

SEQ ID NO: 740 - protein, 11 aa, Artificial Sequence
  source: /note="Description of Artificial Sequence: Synthetic peptide"
DKTHTCPSCPA

SEQ ID NO: 741 - protein, 5 aa, Artificial Sequence
  source: /note="Description of Artificial Sequence: Synthetic peptide"
GGGGS

SEQ ID NO: 742 - protein, 5 aa, Artificial Sequence
  source: /note="Description of Artificial Sequence: Synthetic peptide"
ADAAP

SEQ ID NO: 743 - protein, 11 aa, Artificial Sequence
  source: /note="Description of Artificial Sequence: Synthetic peptide"
ADAAPTVSIFP

SEQ ID NO: 744 - protein, 12 aa, Artificial Sequence
  source: /note="Description of Artificial Sequence: Synthetic peptide"
ADAAPTVSIFPP

SEQ ID NO: 745 - protein, 6 aa, Artificial Sequence
  source: /note="Description of Artificial Sequence: Synthetic peptide"
AKTTAP

SEQ ID NO: 746 - protein, 13 aa, Artificial Sequence
  source: /note="Description of Artificial Sequence: Synthetic peptide"
AKTTAPSVYPLAP

SEQ ID NO: 747 - protein, 17 aa, Artificial Sequence
  source: /note="Description of Artificial Sequence: Synthetic peptide"
AKTTPKLEEGEFSEARV

SEQ ID NO: 748 - protein, 9 aa, Artificial Sequence
  source: /note="Description of Artificial Sequence: Synthetic peptide"
AKTTPKLGG

SEQ ID NO: 749 - protein, 6 aa, Artificial Sequence
  source: /note="Description of Artificial Sequence: Synthetic peptide"
AKTTPP

SEQ ID NO: 750 - protein, 13 aa, Artificial Sequence
  source: /note="Description of Artificial Sequence: Synthetic peptide"
AKTTPPSVTPLAP

SEQ ID NO: 751 - protein, 6 aa, Artificial Sequence
  source: /note="Description of Artificial Sequence: Synthetic peptide"
ASTKGP

SEQ ID NO: 752 - protein, 13 aa, Artificial Sequence
  source: /note="Description of Artificial Sequence: Synthetic peptide"
ASTKGPSVFPLAP

SEQ ID NO: 753 - protein, 26 aa, Artificial Sequence
  source: /note="Description of Artificial Sequence: Synthetic peptide"
ASTKGPSVFPLAPASTKGPSVFPLAP

SEQ ID NO: 754 - protein, 14 aa, Artificial Sequence
  source: /note="Description of Artificial Sequence: Synthetic peptide"
EGKSSGSGSESKST

SEQ ID NO: 755 - protein, 15 aa, Artificial Sequence
  source: /note="Description of Artificial Sequence: Synthetic peptide"
GEGESGEGESGEGES

SEQ ID NO: 756 - protein, 20 aa, Artificial Sequence
  source: /note="Description of Artificial Sequence: Synthetic peptide"
GEGESGEGESGEGESGEGES

SEQ ID NO: 757 - protein, 15 aa, Artificial Sequence
  source: /note="Description of Artificial Sequence: Synthetic peptide"
GEGGSGEGGSGEGGS

SEQ ID NO: 758 - protein, 15 aa, Artificial Sequence
  source: /note="Description of Artificial Sequence: Synthetic peptide"
GENKVEYAPALMALS

SEQ ID NO: 759 - protein, 15 aa, Artificial Sequence
  source: /note="Description of Artificial Sequence: Synthetic peptide"
GGEGSGGEGSGGEGS

SEQ ID NO: 760 - protein, 15 aa, Artificial Sequence
  source: /note="Description of Artificial Sequence: Synthetic peptide"
GGGESGGEGSGEGGS

SEQ ID NO: 761 - protein, 15 aa, Artificial Sequence
  source: /note="Description of Artificial Sequence: Synthetic peptide"
GGGESGGGESGGGES

SEQ ID NO: 762 - protein, 50 aa, Artificial Sequence
  source: /note="Description of Artificial Sequence: Synthetic polypeptide"
  SITE (1)..(50): /note="This sequence may encompass 1-10 'Gly Gly Gly Gly Ser' repeating units"
GGGGSGGGGSGGGGSGGGGSGGGGSGGGGSGGGGSGGGGSGGGGSGGGGS

SEQ ID NO: 763 - protein, 10 aa, Artificial Sequence
  source: /note="Description of Artificial Sequence: Synthetic peptide"
GGGGSGGGGS

SEQ ID NO: 764 - protein, 20 aa, Artificial Sequence
  source: /note="Description of Artificial Sequence: Synthetic peptide"
GGGGSGGGGSGGGGSGGGGS

SEQ ID NO: 765 - protein, 15 aa, Artificial Sequence
  source: /note="Description of Artificial Sequence: Synthetic peptide"
GGGKSGGGKSGGGKS

SEQ ID NO: 766 - protein, 15 aa, Artificial Sequence
  source: /note="Description of Artificial Sequence: Synthetic peptide"
GGGKSGGKGSGKGGS

SEQ ID NO: 767 - protein, 15 aa, Artificial Sequence
  source: /note="Description of Artificial Sequence: Synthetic peptide"
GGKGSGGKGSGGKGS

SEQ ID NO: 768 - protein, 5 aa, Artificial Sequence
  source: /note="Description of Artificial Sequence: Synthetic peptide"
GGSGG

SEQ ID NO: 769 - protein, 9 aa, Artificial Sequence
  source: /note="Description of Artificial Sequence: Synthetic peptide"
GGSGGGGSG

SEQ ID NO: 770 - protein, 13 aa, Artificial Sequence
  source: /note="Description of Artificial Sequence: Synthetic peptide"
GGSGGGGSGGGGS

SEQ ID NO: 771 - protein, 15 aa, Artificial Sequence
  source: /note="Description of Artificial Sequence: Synthetic peptide"
GHEAAAVMQVQYPAS

SEQ ID NO: 772 - protein, 15 aa, Artificial Sequence
  source: /note="Description of Artificial Sequence: Synthetic peptide"
GKGGSGKGGSGKGGS

SEQ ID NO: 773 - protein, 15 aa, Artificial Sequence
  source: /note="Description of Artificial Sequence: Synthetic peptide"
GKGKSGKGKSGKGKS

SEQ ID NO: 774 - protein, 20 aa, Artificial Sequence
  source: /note="Description of Artificial Sequence: Synthetic peptide"
GKGKSGKGKSGKGKSGKGKS

SEQ ID NO: 775 - protein, 15 aa, Artificial Sequence
  source: /note="Description of Artificial Sequence: Synthetic peptide"
GKPGSGKPGSGKPGS

SEQ ID NO: 776 - protein, 20 aa, Artificial Sequence
  source: /note="Description of Artificial Sequence: Synthetic peptide"
GKPGSGKPGSGKPGSGKPGS

SEQ ID NO: 777 - protein, 15 aa, Artificial Sequence
  source: /note="Description of Artificial Sequence: Synthetic peptide"
GPAKELTPLKEAKVS

SEQ ID NO: 778 - protein, 12 aa, Artificial Sequence
  source: /note="Description of Artificial Sequence: Synthetic peptide"
GSAGSAAGSGEF

SEQ ID NO: 779 - protein, 14 aa, Artificial Sequence
  source: /note="Description of Artificial Sequence: Synthetic peptide"
IRPRAIGGSKPRVA

SEQ ID NO: 780 - protein, 18 aa, Artificial Sequence
  source: /note="Description of Artificial Sequence: Synthetic peptide"
KESGSVSSEQLAQFRSLD

SEQ ID NO: 781 - protein, 15 aa, Artificial Sequence
  source: /note="Description of Artificial Sequence: Synthetic peptide"
KTTPKLEEGEFSEAR

SEQ ID NO: 782 - protein, 6 aa, Artificial Sequence
  source: /note="Description of Artificial Sequence: Synthetic peptide"
QPKAAP

SEQ ID NO: 783 - protein, 13 aa, Artificial Sequence
  source: /note="Description of Artificial Sequence: Synthetic peptide"
QPKAAPSVTLFPP

SEQ ID NO: 784 - protein, 27 aa, Artificial Sequence
  source: /note="Description of Artificial Sequence: Synthetic peptide"
RADAAAAGGGGSGGGGSGGGGSGGGGS

SEQ ID NO: 785 - protein, 12 aa, Artificial Sequence
  source: /note="Description of Artificial Sequence: Synthetic peptide"
RADAAAAGGPGS

SEQ ID NO: 786 - protein, 6 aa, Artificial Sequence
  source: /note="Description of Artificial Sequence: Synthetic peptide"
RADAAP

SEQ ID NO: 787 - protein, 9 aa, Artificial Sequence
  source: /note="Description of Artificial Sequence: Synthetic peptide"
RADAAPTVS

SEQ ID NO: 788 - protein, 6 aa, Artificial Sequence
  source: /note="Description of Artificial Sequence: Synthetic peptide"
SAKTTP

SEQ ID NO: 789 - protein, 18 aa, Artificial Sequence
  source: /note="Description of Artificial Sequence: Synthetic peptide"
SAKTTPKLEEGEFSEARV

SEQ ID NO: 790 - protein, 10 aa, Artificial Sequence
  source: /note="Description of Artificial Sequence: Synthetic peptide"
SAKTTPKLGG

SEQ ID NO: 791 - protein, 14 aa, Artificial Sequence
  source: /note="Description of Artificial Sequence: Synthetic peptide"
STAGDTHLGGEDFD

SEQ ID NO: 792 - protein, 5 aa, Artificial Sequence
  source: /note="Description of Artificial Sequence: Synthetic peptide"
TVAAP

SEQ ID NO: 793 - protein, 12 aa, Artificial Sequence
  source: /note="Description of Artificial Sequence: Synthetic peptide"
TVAAPSVFIFPP

SEQ ID NO: 794 - protein, 24 aa, Artificial Sequence
  source: /note="Description of Artificial Sequence: Synthetic peptide"
TVAAPSVFIFPPTVAAPSVFIFPP

SEQ ID NO: 795 - protein, 18 aa, Artificial Sequence
  source: /note="Description of Artificial Sequence: Synthetic peptide"
GSTSGSGKPGSGEGSTKG

SEQ ID NO: 796 - protein, 19 aa, Artificial Sequence
  source: /note="Description of Artificial Sequence: Synthetic peptide"
PRGASKSGSASQTGSAPGS

SEQ ID NO: 797 - protein, 19 aa, Artificial Sequence
  source: /note="Description of Artificial Sequence: Synthetic peptide"
GTAAAGAGAAGGAAAGAAG

SEQ ID NO: 798 - protein, 19 aa, Artificial Sequence
  source: /note="Description of Artificial Sequence: Synthetic peptide"
GTSGSSGSGSGGSGSGGGG

SEQ ID NO: 799 - protein, 119 aa, Artificial Sequence [sequence omitted]

SEQ ID NO: 800 - protein, 106 aa, Artificial Sequence [sequence omitted]

SEQ ID NO: 801 - protein, 125 aa, Artificial Sequence
  source: /note="Description of Artificial Sequence: Synthetic polypeptide"
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 802 - protein, 109 aa, Artificial Sequence
  source: /note="Description of Artificial Sequence: Synthetic polypeptide"
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 803 - protein, 119 aa, Artificial Sequence
  source: /note="Description of Artificial Sequence: Synthetic polypeptide"
QVQLQQSGAELARPGASVKMSCKASGYTFTSYTMHWVKQRPGQGLEWIGYINPSSGYTKYNQKFKDKATLTADKSSSTAYMQLSSLTSEDSAVYYCARWQDYDVYFDYWGQGTTLTVSS

SEQ ID NO: 804 - protein, 106 aa, Artificial Sequence
  source: /note="Description of Artificial Sequence: Synthetic polypeptide"
QIVLSQSPAILSASPGEKVTMTCRASSSVSYMHWYQQKPGSSPKPWIYATSNLASGVPARFSGSGSGTSYSLTISRVEAEDAATYYCQQWSSNPPTFGGGTKLETK

SEQ ID NO: 805 - protein, 106 aa, Artificial Sequence
  source: /note="Description of Artificial Sequence: Synthetic polypeptide"
QIVLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGSGTKLEIN

SEQ ID NO: 806 - protein, 119 aa, Artificial Sequence [sequence omitted]

SEQ ID NO: 807 - protein, 106 aa, Artificial Sequence [sequence omitted]

SEQ ID NO: 808 - protein, 118 aa, Artificial Sequence [sequence omitted]

SEQ ID NO: 809 - protein, 108 aa, Artificial Sequence [sequence omitted]

SEQ ID NO: 810 - protein, 124 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKDRFISRDDSKNSLYLQMNSLKTEDTAVYYCVRHGNFGNSYVSWFAYWGQGTLVTVSS

SEQ ID NO: 811 - protein, 107 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPWTPARFSGSLLGGKAALIGAQAEDEADYYCALWYSNLWVFGGGTKLTVL

SEQ ID NO: 812 - protein, 119 aa, Artificial Sequence
  source: /note="Description of Artificial Sequence: Synthetic polypeptide"
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 813 - protein, 105 aa, Artificial Sequence
  source: /note="Description of Artificial Sequence: Synthetic polypeptide"
DIQLTQSPAIMSASPGEKVTMTCRASSSVSYMNWYQQKSGTSPKRWIYDTSKVASGVPYRFSGSGSGTSYSLISSMEAEDAATYYCQQWSSNPLTFGAGTKLELK

SEQ ID NO: 814 - protein, 124 aa, Artificial Sequence
  source: /note="Description of Artificial Sequence: Synthetic polypeptide"
EVQLVESGGGLVQPGGSLRLSCAASGFTFNTYAMNWVRQAPGKGLEWVARIRSKYNNYATYYADSVKDRFISRDDSKNSLYLQMNSLKTEDTAVYYCVRHGNFGNSYVSWFAYWGQGTLVTVSS

SEQ ID NO: 815 - protein, 125 aa, Artificial Sequence
  source: /note="Description of Artificial Sequence: Synthetic polypeptide"
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 816 - protein, 125 aa, Artificial Sequence
  source: /note="Description of Artificial Sequence: Synthetic polypeptide"
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 817 - protein, 109 aa, Artificial Sequence
  source: /note="Description of Artificial Sequence: Synthetic polypeptide"
QTVVTQEPSLTVSPGGTVTLTCGSSTGAVTSGNYPNWVQQKPGQAPRGLIGGTKFLAPGTPQRFSGSLLGGKAALTLSGVQPEDEAEYYCVLWYSNRWVFGGGTKLTVL

SEQ ID NO: 818 - protein, 125 aa, Artificial Sequence
  source: /note="Description of Artificial Sequence: Synthetic polypeptide"
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 819 - protein, 109 aa, Artificial Sequence
  source: /note="Description of Artificial Sequence: Synthetic polypeptide"
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 820 - protein, 254 aa, Artificial Sequence
  source: /note="Description of Artificial Sequence: Synthetic polypeptide"
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 821 - protein, 119 aa, Artificial Sequence
  source: /note="Description of Artificial Sequence: Synthetic polypeptide"
QVQLVQSGAEVKKPGASVKVSCKASGYTFTRYTMHWVRQAPGQGLEWMGYINPSRGYTNYNQKFKDRVTMTTDTSISTAYMELSRLRSDDTAVYYCARYYDDHYCLDYWGQGTLVTVSS

SEQ ID NO: 822 - protein, 106 aa, Artificial Sequence
  source: /note="Description of Artificial Sequence: Synthetic polypeptide"
EIVLTQSPATLSLSPGERATLSCSASSSVSYMNWYQQKPGQAPRLLIYDTSKLASGVPAHFRGSGSGTDFTLTISSLEPEDFAVYYCQQWSSNPFTFGQGTKVEIK

SEQ ID NO: 823 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVSRIRSKYNNYATYYADSVKDRFTISRDDSKNTLYLQMNSLRAEDTAVYYCARHGNFGNSYVSWFAYWGQGTMVTVSS

SEQ ID NO: 824 - protein, 109 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 825 - protein, 125 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 826 - protein, 109 aa, Artificial Sequence
  source: /note="Description of Artificial Sequence: Synthetic polypeptide"
QAVVTQEPSLTVSPGGTVTLTCRSSTGAVTTSNYANWVQEKPGQAPRGLIGGTNKRAPWTPARFSGSLLGGKAALTITGAQAEDEADYYCALWYSNLWVFGGGTKLTVL

SEQ ID NO: 827 - protein, 125 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 828 - protein, 109 aa, Artificial Sequence
  source: /note="Description of Artificial Sequence: Synthetic polypeptide"
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 829 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 830 - protein, 109 aa, Artificial Sequence
  source: /note="Description of Artificial Sequence: Synthetic polypeptide"
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 831 - protein, 101 aa, Artificial Sequence
  source: /note="Description of Artificial Sequence: Synthetic polypeptide"
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGT

SEQ ID NO: 832 - protein, 119 aa, Artificial Sequence
  source: /note="Description of Artificial Sequence: Synthetic polypeptide"
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYSLDYWGQGTPVTVSS

SEQ ID NO: 833 - protein, 122 aa, Artificial Sequence
  source: /note="Description of Artificial Sequence: Synthetic polypeptide"
EVQLQQSGPELVKPGASMKISCKASGYSFTGYTMNWVKQSHGKNLEWMGLINPYKGVSTYNQKFKDKATLTVDKSSSTAYMELLSLTSEDSAVYYCARSGYYGDSDWYFDVWGQGTTLTVFS

SEQ ID NO: 834 - protein, 107 aa, Artificial Sequence
  source: /note="Description of Artificial Sequence: Synthetic polypeptide"
DIQMTQTTSSLSASLGDRVTISCRASQDIRNYLNWYQQKPDGTVKLLIYYTSRLHSGVPSKFSGSGSGTDYSLTISNLEQEDIATYFCQQGNTLPWTFAGGTKLEIK

SEQ ID NO: 835 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSS

SEQ ID NO: 836 - protein, 109 aa, Artificial Sequence
  source: /note="Description of Artificial Sequence: Synthetic polypeptide"
QAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 837 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 838 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 839 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 840 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 841 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 842 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 843 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 844 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 845 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 846 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 847 - protein, 125 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 848 - protein, 254 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 849 - protein, 257 aa, Artificial Sequence
  source: /note="Description of Artificial Sequence: Synthetic polypeptide"
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSSGGGGSGGGGSGGGGSQAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVLGSHHHHHH

SEQ ID NO: 850 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSS

SEQ ID NO: 851 - protein, 109 aa, Artificial Sequence
  source: /note="Description of Artificial Sequence: Synthetic polypeptide"
QAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL

SEQ ID NO: 852 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSSGGGGSGGGGSGGGGSGGGGSQAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVL

SEQ ID NO: 853 - protein, 125 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSS

SEQ ID NO: 854 - protein, 254 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVL

SEQ ID NO: 855 - protein, 5 aa, Artificial Sequence
  source: /note="Description of Artificial Sequence: Synthetic peptide"
RYTMH

SEQ ID NO: 856 - protein, 10 aa, Artificial Sequence
  source: /note="Description of Artificial Sequence: Synthetic peptide"
SASSSVSYMN

SEQ ID NO: 857 - protein, 5 aa, Artificial Sequence
  source: /note="Description of Artificial Sequence: Synthetic peptide"
TYAMN

SEQ ID NO: 858 - protein, 14 aa, Artificial Sequence
  source: /note="Description of Artificial Sequence: Synthetic peptide"
RSSTGAVTTSNYAN

SEQ ID NO: 859 - protein, 5 aa, Artificial Sequence
  source: /note="Description of Artificial Sequence: Synthetic peptide"
SYTMH

SEQ ID NO: 860 - protein, 10 aa, Artificial Sequence
  source: /note="Description of Artificial Sequence: Synthetic peptide"
RASSSVSYMH

SEQ ID NO: 861 - protein, 10 aa, Artificial Sequence
  source: /note="Description of Artificial Sequence: Synthetic peptide"
RASSSVSYMN

SEQ ID NO: 862 - protein, 5 aa, Artificial Sequence
  source: /note="Description of Artificial Sequence: Synthetic peptide"
GYGMH

SEQ ID NO: 863 - protein, 11 aa, Artificial Sequence
  source: /note="Description of Artificial Sequence: Synthetic peptide"
RASQSVSSYLA

SEQ ID NO: 864 - protein, 5 aa, Artificial Sequence
  source: /note="Description of Artificial Sequence: Synthetic peptide"
SYAMN

SEQ ID NO: 865 - protein, 14 aa, Artificial Sequence
  source: /note="Description of Artificial Sequence: Synthetic peptide"
GSSTGAVTSGNYPN

SEQ ID NO: 866 - protein, 5 aa, Artificial Sequence
  source: /note="Description of Artificial Sequence: Synthetic peptide"
KYAMN

SEQ ID NO: 867 - protein, 14 aa, Artificial Sequence
  source: /note="Description of Artificial Sequence: Synthetic peptide"
GSSTGAVTTSNYAN

SEQ ID NO: 868 - protein, 5 aa, Artificial Sequence
  source: /note="Description of Artificial Sequence: Synthetic peptide"
GYTMN

SEQ ID NO: 869 - protein, 11 aa, Artificial Sequence
  source: /note="Description of Artificial Sequence: Synthetic peptide"
RASQDIRNYLN

SEQ ID NO: 870 - protein, 5 aa, Artificial Sequence
  source: /note="Description of Artificial Sequence: Synthetic peptide"
TYAMS

SEQ ID NO: 871 - protein, 5 aa, Artificial Sequence
  source: /note="Description of Artificial Sequence: Synthetic peptide"
TYAMH

SEQ ID NO: 872 - protein, 14 aa, Artificial Sequence
  source: /note="Description of Artificial Sequence: Synthetic peptide"
GSSTGAVTSSNYAN

SEQ ID NO: 873 - protein, 14 aa, Artificial Sequence
  source: /note="Description of Artificial Sequence: Synthetic peptide"
GSSTGAVTSGHYAN

SEQ ID NO: 874 - protein, 14 aa, Artificial Sequence
  source: /note="Description of Artificial Sequence: Synthetic peptide"
KSSTGAVTTSNYAN

SEQ ID NO: 875 - protein, 17 aa, Artificial Sequence
  source: /note="Description of Artificial Sequence: Synthetic peptide"
YINPSRGYTNYNQKFKD

SEQ ID NO: 876 - protein, 7 aa, Artificial Sequence
  source: /note="Description of Artificial Sequence: Synthetic peptide"
DTSKLAS

SEQ ID NO: 877 - protein, 19 aa, Artificial Sequence
  source: /note="Description of Artificial Sequence: Synthetic peptide"
RIRSKYNNYATYYADSVKD

SEQ ID NO: 878 - protein, 7 aa, Artificial Sequence
  source: /note="Description of Artificial Sequence: Synthetic peptide"
GTNKRAP

SEQ ID NO: 879 - protein, 17 aa, Artificial Sequence
  source: /note="Description of Artificial Sequence: Synthetic peptide"
YINPSSGYTKYNQKFKD

SEQ ID NO: 880 - protein, 7 aa, Artificial Sequence
  source: /note="Description of Artificial Sequence: Synthetic peptide"
ATSNLAS

SEQ ID NO: 881 - protein, 7 aa, Artificial Sequence
  source: /note="Description of Artificial Sequence: Synthetic peptide"
DTSKVAS

SEQ ID NO: 882 - protein, 17 aa, Artificial Sequence
  source: /note="Description of Artificial Sequence: Synthetic peptide"
YINPSRGYTNYNQKVKD

SEQ ID NO: 883 - protein, 17 aa, Artificial Sequence
  source: /note="Description of Artificial Sequence: Synthetic peptide"
VIWYDGSKKYYVDSVKG

SEQ ID NO: 884 - protein, 15 aa, Artificial Sequence
  source: /note="Description of Artificial Sequence: Synthetic peptide"
RIRSKYNNYATYYAD

SEQ ID NO: 885 - protein, 19 aa, Artificial Sequence
  source: /note="Description of Artificial Sequence: Synthetic peptide"
RIRSKYNNYATYYADSVKG

SEQ ID NO: 886 - protein, 7 aa, Artificial Sequence
  source: /note="Description of Artificial Sequence: Synthetic peptide"
GTKFLAP

SEQ ID NO: 887 - protein, 17 aa, Artificial Sequence
  source: /note="Description of Artificial Sequence: Synthetic peptide"
LINPYKGVSTYNQKFKD

SEQ ID NO: 888 - protein, 6 aa, Artificial Sequence
  source: /note="Description of Artificial Sequence: Synthetic peptide"
YTSRLH

SEQ ID NO: 889 - protein, 19 aa, Artificial Sequence
  source: /note="Description of Artificial Sequence: Synthetic peptide"
RIRSKANNYATYYADSVKG

SEQ ID NO: 890 - protein, 20 aa, Artificial Sequence
  source: /note="Description of Artificial Sequence: Synthetic peptide"
RIRSKANNYYATYYADSVKG

SEQ ID NO: 891 - protein, 19 aa, Artificial Sequence
  source: /note="Description of Artificial Sequence: Synthetic peptide"
RIRSKANSYATYYADSVKG

SEQ ID NO: 892 - protein, 19 aa, Artificial Sequence
  source: /note="Description of Artificial Sequence: Synthetic peptide"
RIRSKYNNYATAYADSVKG

SEQ ID NO: 893 - protein, 7 aa, Artificial Sequence
  source: /note="Description of Artificial Sequence: Synthetic peptide"
DTNKRAP

SEQ ID NO: 894 - protein, 7 aa, Artificial Sequence
  source: /note="Description of Artificial Sequence: Synthetic peptide"
GTNNRAP

SEQ ID NO: 895 - protein, 7 aa, Artificial Sequence
  source: /note="Description of Artificial Sequence: Synthetic peptide"
GTNKRAS

SEQ ID NO: 896 - protein, 7 aa, Artificial Sequence
  source: /note="Description of Artificial Sequence: Synthetic peptide"
GTSNKHS

SEQ ID NO: 897 - protein, 18 aa, Artificial Sequence
  source: /note="Description of Artificial Sequence: Synthetic peptide"
RIRSNGGYSTYYADSVKG

SEQ ID NO: 898 - protein, 10 aa, Artificial Sequence
  source: /note="Description of Artificial Sequence: Synthetic peptide"
YYDDHYCLDY

SEQ ID NO: 899 - protein, 9 aa, Artificial Sequence
  source: /note="Description of Artificial Sequence: Synthetic peptide"
QQWSSNPFT

SEQ ID NO: 900 - protein, 14 aa, Artificial Sequence
  source: /note="Description of Artificial Sequence: Synthetic peptide"
HGNFGNSYVSWFAY

SEQ ID NO: 901 - protein, 9 aa, Artificial Sequence
  source: /note="Description of Artificial Sequence: Synthetic peptide"
ALWYSNLWV

SEQ ID NO: 902 - protein, 10 aa, Artificial Sequence
  source: /note="Description of Artificial Sequence: Synthetic peptide"
WQDYDVYFDY

SEQ ID NO: 903 - protein, 9 aa, Artificial Sequence
  source: /note="Description of Artificial Sequence: Synthetic peptide"
QQWSSNPPT

SEQ ID NO: 904 - protein, 9 aa, Artificial Sequence
  source: /note="Description of Artificial Sequence: Synthetic peptide"
QQWSSNPLT

SEQ ID NO: 905 - protein, 9 aa, Artificial Sequence
  source: /note="Description of Artificial Sequence: Synthetic peptide"
QMGYWHFDL

SEQ ID NO: 906 - protein, 10 aa, Artificial Sequence
  source: /note="Description of Artificial Sequence: Synthetic peptide"
QQRSNWPPLT

SEQ ID NO: 907 - protein, 16 aa, Artificial Sequence
  source: /note="Description of Artificial Sequence: Synthetic peptide"
VRHGNFGNSYVSWFAY

SEQ ID NO: 908 - protein, 14 aa, Artificial Sequence
  source: /note="Description of Artificial Sequence: Synthetic peptide"
HGNFGNSYVSWWAY

SEQ ID NO: 909 - protein, 9 aa, Artificial Sequence
  source: /note="Description of Artificial Sequence: Synthetic peptide"
VLWYSNRWV

SEQ ID NO: 910 - protein, 14 aa, Artificial Sequence
  source: /note="Description of Artificial Sequence: Synthetic peptide"
HGNFGNSYISYWAY

SEQ ID NO: 911 - protein, 14 aa, Artificial Sequence
  source: /note="Description of Artificial Sequence: Synthetic peptide"
HGNFGDSYVSWFAY

SEQ ID NO: 912 - protein, 9 aa, Artificial Sequence
  source: /note="Description of Artificial Sequence: Synthetic peptide"
ALWYSNHWV

SEQ ID NO: 913 - protein, 10 aa, Artificial Sequence
  source: /note="Description of Artificial Sequence: Synthetic peptide"
YYDDHYSLDY

SEQ ID NO: 914 - protein, 13 aa, Artificial Sequence
  source: /note="Description of Artificial Sequence: Synthetic peptide"
SGYYGDSDWYFDV

SEQ ID NO: 915 - protein, 9 aa, Artificial Sequence
  source: /note="Description of Artificial Sequence: Synthetic peptide"
QQGNTLPWT

SEQ ID NO: 916 - protein, 14 aa, Artificial Sequence
  source: /note="Description of Artificial Sequence: Synthetic peptide"
HGNFGDEYVSWFAY

SEQ ID NO: 917 - protein, 14 aa, Artificial Sequence
  source: /note="Description of Artificial Sequence: Synthetic peptide"
HGNFGDPYVSWFAY

SEQ ID NO: 918 - protein, 14 aa, Artificial Sequence
  source: /note="Description of Artificial Sequence: Synthetic peptide"
HGNFGDSYVSWFDY

SEQ ID NO: 919 - protein, 14 aa, Artificial Sequence
  source: /note="Description of Artificial Sequence: Synthetic peptide"
HGNFGQSYVSWFAY

SEQ ID NO: 920 - protein, 14 aa, Artificial Sequence
  source: /note="Description of Artificial Sequence: Synthetic peptide"
HGNFGNSYVSWFDY

SEQ ID NO: 921 - protein, 9 aa, Artificial Sequence
  source: /note="Description of Artificial Sequence: Synthetic peptide"
LLWYSNLWV

SEQ ID NO: 922 - protein, 14 aa, Artificial Sequence
  source: /note="Description of Artificial Sequence: Synthetic peptide"
HGNFGNSYVSWFAH

SEQ ID NO: 923 - protein, 7 aa, Artificial Sequence
  source: /note="Description of Artificial Sequence: Synthetic peptide"
GYTFTRY

SEQ ID NO: 924 - protein, 6 aa, Artificial Sequence
  source: /note="Description of Artificial Sequence: Synthetic peptide"
SSSVSY

SEQ ID NO: 925 - protein, 7 aa, Artificial Sequence
  source: /note="Description of Artificial Sequence: Synthetic peptide"
GFTFNTY

SEQ ID NO: 926 - protein, 10 aa, Artificial Sequence
  source: /note="Description of Artificial Sequence: Synthetic peptide"
STGAVTTSNY

SEQ ID NO: 927 - protein, 7 aa, Artificial Sequence
  source: /note="Description of Artificial Sequence: Synthetic peptide"
GYTFTSY

SEQ ID NO: 928 - protein, 7 aa, Artificial Sequence
  source: /note="Description of Artificial Sequence: Synthetic peptide"
GFKFSGY

SEQ ID NO: 929 - protein, 7 aa, Artificial Sequence
  source: /note="Description of Artificial Sequence: Synthetic peptide"
SQSVSSY

SEQ ID NO: 930 - protein, 7 aa, Artificial Sequence
  source: /note="Description of Artificial Sequence: Synthetic peptide"
GFTFSTY

SEQ ID NO: 931 - protein, 7 aa, Artificial Sequence
  source: /note="Description of Artificial Sequence: Synthetic peptide"
GFTFNSY

SEQ ID NO: 932 - protein, 10 aa, Artificial Sequence
  source: /note="Description of Artificial Sequence: Synthetic peptide"
STGAVTSGNY

SEQ ID NO: 933 - protein, 7 aa, Artificial Sequence
  source: /note="Description of Artificial Sequence: Synthetic peptide"
GFTFNKY

SEQ ID NO: 934 - protein, 7 aa, Artificial Sequence
  source: /note="Description of Artificial Sequence: Synthetic peptide"
GYSFTGY

SEQ ID NO: 935 - protein, 7 aa, Artificial Sequence
  source: /note="Description of Artificial Sequence: Synthetic peptide"
SQDIRNY

SEQ ID NO: 936 - protein, 6 aa, Artificial Sequence
  source: /note="Description of Artificial Sequence: Synthetic peptide"
NPSRGY

SEQ ID NO: 937 - protein, 3 aa, Artificial Sequence
  source: /note="Description of Artificial Sequence: Synthetic peptide"
DTS

SEQ ID NO: 938 - protein, 8 aa, Artificial Sequence
  source: /note="Description of Artificial Sequence: Synthetic peptide"
RSKYNNYA

SEQ ID NO: 939 - protein, 6 aa, Artificial Sequence
  source: /note="Description of Artificial Sequence: Synthetic peptide"
NPSSGY

SEQ ID NO: 940 - protein, 3 aa, Artificial Sequence
  source: /note="Description of Artificial Sequence: Synthetic peptide"
ATS

SEQ ID NO: 941 - protein, 6 aa, Artificial Sequence
  source: /note="Description of Artificial Sequence: Synthetic peptide"
WYDGSK

SEQ ID NO: 942 - protein, 9 aa, Artificial Sequence
  source: /note="Description of Artificial Sequence: Synthetic peptide"
RSKYNNYAT

SEQ ID NO: 943 - protein, 3 aa, Artificial Sequence
  source: /note="Description of Artificial Sequence: Synthetic peptide"
GTK

SEQ ID NO: 944 - protein, 6 aa, Artificial Sequence
  source: /note="Description of Artificial Sequence: Synthetic peptide"
NPYKGV

SEQ ID NO: 945 - protein, 3 aa, Artificial Sequence
  source: /note="Description of Artificial Sequence: Synthetic peptide"
YTS

SEQ ID NO: 946 - protein, 6 aa, Artificial Sequence
  source: /note="Description of Artificial Sequence: Synthetic peptide"
WSSNPF

SEQ ID NO: 947 - protein, 6 aa, Artificial Sequence
  source: /note="Description of Artificial Sequence: Synthetic peptide"
WYSNLW

SEQ ID NO: 948 - protein, 6 aa, Artificial Sequence
  source: /note="Description of Artificial Sequence: Synthetic peptide"
WSSNPP

SEQ ID NO: 949 - protein, 6 aa, Artificial Sequence
  source: /note="Description of Artificial Sequence: Synthetic peptide"
WSSNPL

SEQ ID NO: 950 - protein, 7 aa, Artificial Sequence
  source: /note="Description of Artificial Sequence: Synthetic peptide"
RSNWPPL

SEQ ID NO: 951 - protein, 13 aa, Artificial Sequence
  source: /note="Description of Artificial Sequence: Synthetic peptide"
HGNFGNSYVSWFA

SEQ ID NO: 952 - protein, 6 aa, Artificial Sequence
  source: /note="Description of Artificial Sequence: Synthetic peptide"
WYSNRW

SEQ ID NO: 953 - protein, 6 aa, Artificial Sequence
  source: /note="Description of Artificial Sequence: Synthetic peptide"
WYSNHW

SEQ ID NO: 954 - protein, 6 aa, Artificial Sequence
  source: /note="Description of Artificial Sequence: Synthetic peptide"
GNTLPW

SEQ ID NO: 955 - protein, 10 aa, Artificial Sequence
  source: /note="Description of Artificial Sequence: Synthetic peptide"
GYTFTRYTMH

SEQ ID NO: 956 - protein, 10 aa, Artificial Sequence
  source: /note="Description of Artificial Sequence: Synthetic peptide"
GFTFNTYAMN

SEQ ID NO: 957 - protein, 10 aa, Artificial Sequence
  source: /note="Description of Artificial Sequence: Synthetic peptide"
GYTFTSYTMH

SEQ ID NO: 958 - protein, 10 aa, Artificial Sequence
  source: /note="Description of Artificial Sequence: Synthetic peptide"
GFKFSGYGMH

SEQ ID NO: 959 - protein, 10 aa, Artificial Sequence
  source: /note="Description of Artificial Sequence: Synthetic peptide"
GFTFSTYAMN

SEQ ID NO: 960 - protein, 10 aa, Artificial Sequence
  source: /note="Description of Artificial Sequence: Synthetic peptide"
GFTFNSYAMN

SEQ ID NO: 961 - protein, 10 aa, Artificial Sequence
  source: /note="Description of Artificial Sequence: Synthetic peptide"
GFTFNKYAMN

SEQ ID NO: 962 - protein, 10 aa, Artificial Sequence
  source: /note="Description of Artificial Sequence: Synthetic peptide"
GYSFTGYTMN

SEQ ID NO: 963 - protein, 18 aa, Artificial Sequence
  source: /note="Description of Artificial Sequence: Synthetic peptide"
RIRSKYNNYATYYADSVK

SEQ ID NO: 964 - protein, 7 aa, Artificial Sequence
  source: /note="Description of Artificial Sequence: Synthetic peptide"
YTSRLHS

SEQ ID NO: 965 - protein, 152 aa, Artificial Sequence
  source: /note="Description of Artificial Sequence: Synthetic polypeptide"
MQIFVKTLTGKTITLEVEPSDTIENVKAKIQDKEGIPPDQQWLWFAGKQLEDGRTLSDYNIQKESTLKLWLVDKAAMQIFVYTRTGKTITLEVEPSDTIENVKAKIQDKEGIPPDQQRLIWAGKQLEDGRTLSDYNIALESGLHLVLRLRAA

SEQ ID NO: 966 - protein, 13 aa, Artificial Sequence
  source: /note="Description of Artificial Sequence: Synthetic peptide"
KASGYKFTSYVMH

SEQ ID NO: 967 - protein, 16 aa, Artificial Sequence
  source: /note="Description of Artificial Sequence: Synthetic peptide"
YINPYNDVTKYNEKFK

SEQ ID NO: 968 - protein, 11 aa, Artificial Sequence
  source: /note="Description of Artificial Sequence: Synthetic peptide"
GSYYDYDGFVY

SEQ ID NO: 969 - protein, 10 aa, Artificial Sequence
  source: /note="Description of Artificial Sequence: Synthetic peptide"
SATSSVSYMH

SEQ ID NO: 970 - protein, 120 aa, Artificial Sequence
  source: /note="Description of Artificial Sequence: Synthetic polypeptide"
EVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSA

SEQ ID NO: 971 - protein, 106 aa, Artificial Sequence
  source: /note="Description of Artificial Sequence: Synthetic polypeptide"
QIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELK

SEQ ID NO: 972 - protein, 10 aa, Artificial Sequence
  source: /note="Description of Artificial Sequence: Synthetic peptide"
GYTFTTYWIQ

SEQ ID NO: 973 - protein, 17 aa, Artificial Sequence
  source: /note="Description of Artificial Sequence: Synthetic peptide"
AVYPGDADTRYTQKFQG

SEQ ID NO: 974 - protein, 11 aa, Artificial Sequence
  source: /note="Description of Artificial Sequence: Synthetic peptide"
DAGLEYYALDY

SEQ ID NO: 975 - protein, 5 aa, Artificial Sequence
  source: /note="Description of Artificial Sequence: Synthetic peptide"
TYWIQ

SEQ ID NO: 976 - protein, 7 aa, Artificial Sequence
  source: /note="Description of Artificial Sequence: Synthetic peptide"
GYTFTTY

SEQ ID NO: 977 - protein, 6 aa, Artificial Sequence
  source: /note="Description of Artificial Sequence: Synthetic peptide"
YPGDAD

SEQ ID NO: 978 - protein, 8 aa, Artificial Sequence
  source: /note="Description of Artificial Sequence: Synthetic peptide"
GYTFTTYW

SEQ ID NO: 979 - protein, 8 aa, Artificial Sequence
  source: /note="Description of Artificial Sequence: Synthetic peptide"
VYPGDADT

SEQ ID NO: 980 - protein, 13 aa, Artificial Sequence
  source: /note="Description of Artificial Sequence: Synthetic peptide"
GRDAGLEYYALDY

SEQ ID NO: 981 - protein, 120 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSS

SEQ ID NO: 982 - protein, 11 aa, Artificial Sequence
  source: /note="Description of Artificial Sequence: Synthetic peptide"
RASQDVGTAVA

SEQ ID NO: 983 - protein, 7 aa, Artificial Sequence
  source: /note="Description of Artificial Sequence: Synthetic peptide"
WASTRHT

SEQ ID NO: 984 - protein, 10 aa, Artificial Sequence
  source: /note="Description of Artificial Sequence: Synthetic peptide"
QQYANFPLYT

SEQ ID NO: 985 - protein, 7 aa, Artificial Sequence
  source: /note="Description of Artificial Sequence: Synthetic peptide"
SQDVGTA

SEQ ID NO: 986 - protein, 3 aa, Artificial Sequence
  source: /note="Description of Artificial Sequence: Synthetic peptide"
WAS

SEQ ID NO: 987 - protein, 7 aa, Artificial Sequence
  source: /note="Description of Artificial Sequence: Synthetic peptide"
YANFPLY

SEQ ID NO: 988 - protein, 6 aa, Artificial Sequence
  source: /note="Description of Artificial Sequence: Synthetic peptide"
QDVGTA

SEQ ID NO: 989 - protein, 108 aa, Artificial Sequence
  source: /note="Description of Artificial Sequence: Synthetic polypeptide"
EIVMTQSPATLSVSPGERATLSCRASQDVGTAVAWYQQKPGQAPRLLIYWASTRHTGIPARFSGSGSGTEFTLTISSLQSEDFAVYFCQQYANFPLYTFGQGTKLEIK

SEQ ID NO: 990 - protein, 10 aa, Artificial Sequence
  source: /note="Description of Artificial Sequence: Synthetic peptide"
GYSFTNYWMN

SEQ ID NO: 991 - protein, 17 aa, Artificial Sequence
  source: /note="Description of Artificial Sequence: Synthetic peptide"
MIHPSDSEIRLNQKFQG

SEQ ID NO: 992 - protein, 10 aa, Artificial Sequence
  source: /note="Description of Artificial Sequence: Synthetic peptide"
WYYLSSPMDY

SEQ ID NO: 993 - protein, 5 aa, Artificial Sequence
  source: /note="Description of Artificial Sequence: Synthetic peptide"
NYWMN

SEQ ID NO: 994 - protein, 7 aa, Artificial Sequence
  source: /note="Description of Artificial Sequence: Synthetic peptide"
GYSFTNY

SEQ ID NO: 995 - protein, 6 aa, Artificial Sequence
  source: /note="Description of Artificial Sequence: Synthetic peptide"
HPSDSE

SEQ ID NO: 996 - protein, 8 aa, Artificial Sequence
  source: /note="Description of Artificial Sequence: Synthetic peptide"
GYSFTNYW

SEQ ID NO: 997 - protein, 8 aa, Artificial Sequence
  source: /note="Description of Artificial Sequence: Synthetic peptide"
IHPSDSEI

SEQ ID NO: 998 - protein, 12 aa, Artificial Sequence
  source: /note="Description of Artificial Sequence: Synthetic peptide"
SRWYYLSSPMDY

SEQ ID NO: 999 - protein, 119 aa, Artificial Sequence
  source: /note="Description of Artificial Sequence: Synthetic polypeptide"
EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSS

SEQ ID NO: 1000 - protein, 9 aa, Artificial Sequence
  source: /note="Description of Artificial Sequence: Synthetic peptide"
QQYSSYPYT

SEQ ID NO: 1001 - protein, 6 aa, Artificial Sequence
  source: /note="Description of Artificial Sequence: Synthetic peptide"
YSSYPY

SEQ ID NO: 1002 - protein, 107 aa, Artificial Sequence
  source: /note="Description of Artificial Sequence: Synthetic polypeptide"
EIVMTQSPATLSVSPGERATLSCRASQDVGTAVAWYQQKPGQAPRLLIYWASTRHTGIPARFSGSGSGTEFTLTISSLQSEDFAVYFCQQYSSYPYTFGQGTKLEIK

SEQ ID NO: 1003 - protein, 4 aa, Artificial Sequence
  source: /note="Description of Artificial Sequence: Synthetic peptide"
GFLG

SEQ ID NO: 1004 - protein, 4 aa, Artificial Sequence
  source: /note="Description of Artificial Sequence: Synthetic peptide"
ALAL

SEQ ID NO: 1005 - protein, 4 aa, Artificial Sequence
  source: /note="Description of Artificial Sequence: Synthetic peptide"
RGDS

SEQ ID NO: 1006 - protein, 492 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 1007 - protein, 215 aa, Artificial Sequence
  source: /note="Description of Artificial Sequence: Synthetic polypeptide"
EIVMTQSPATLSVSPGERATLSCRASQDVGTAVAWYQQKPGQAPRLLIYWASTRHTGIPARFSGSGSGTEFTLTISSLQSEDFAVYFCQQYANFPLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1008 - protein, 99 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGS

SEQ ID NO: 1009 - protein, 492 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSSGGGGSGGGGSGGGGSGGGGSQAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVLGGGGS

SEQ ID NO: 1010 - protein, 492 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 1011 - protein, 491 aa, Artificial Sequence
  source: /note="Description of Artificial Sequence: Synthetic polypeptide"
EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 1012 - protein, 214 aa, Artificial Sequence
  source: /note="Description of Artificial Sequence: Synthetic polypeptide"
EIVMTQSPATLSVSPGERATLSCRASQDVGTAVAWYQQKPGQAPRLLIYWASTRHTGIPARFSGSGSGTEFTLTISSLQSEDFAVYFCQQYSSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1013 - protein, 138 aa, Artificial Sequence
  source: /note="Description of Artificial Sequence: Synthetic polypeptide"
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGS

SEQ ID NO: 1014 - protein, 223 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 1015 - protein, 259 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 1016 - protein, 222 aa, Artificial Sequence
  source: /note="Description of Artificial Sequence: Synthetic polypeptide"
EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 1017 - protein, 8 aa, Artificial Sequence
  source: /note="Description of Artificial Sequence: Synthetic 8xHis tag"
HHHHHHHH

SEQ ID NO: 1018 - protein, 8 aa, Artificial Sequence
  source: /note="Description of Artificial Sequence: Synthetic peptide"
EVNLYFQS

SEQ ID NO: 1019 - protein, 206 aa, Artificial Sequence
  source: /note="Description of Artificial Sequence: Synthetic polypeptide"
SKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDGGGGSGLNDIFEAQKIEWHE

SEQ ID NO: 1020 - protein, 206 aa, Artificial Sequence
  source: /note="Description of Artificial Sequence: Synthetic polypeptide"
SKEIRNALETWGALGQDIDLDIPSFQMSDDIDDIRWEKTSDKKKIAQFRKEKETFEEKDAYKLFKNGTLKIKHLKIHDQDSYKVSIYDTKGKNVLEKTFDLKIQERVSEPKISWTCINTTLTCEVMNGTDPELNLYQDGKHVKLSQRVITHKWTTSLSAKFKCTAGNKVSKESRMETVSCPEKGLDGGGGSGLNDIFEAQKIEWHE

SEQ ID NO: 1021 - protein, 199 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRGGGGSHHHHHHHH

SEQ ID NO: 1022 - protein, 107 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSHHHHHHHH

SEQ ID NO: 1023 - protein, 107 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLESGGGGSHHHHHHHH

SEQ ID NO: 1024 - protein, 107 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLESGGGGSHHHHHHHH

SEQ ID NO: 1025 - protein, 107 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLESGGGGSHHHHHHHH

SEQ ID NO: 1026 - protein, 492 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGS

SEQ ID NO: 1027 - protein, 191 aa, Artificial Sequence
  source: /note="Description of Artificial Sequence: Synthetic polypeptide"
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRGGGS

SEQ ID NO: 1028 - protein, 214 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1029 - protein, 96 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLESGS

SEQ ID NO: 1030 - protein, 96 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLESGS

SEQ ID NO: 1031 - protein, 96 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLESGS

SEQ ID NO: 1032 - protein, 10 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  VARIANT (10)..(10): /replace="Ser"
  SITE (1)..(10): /note="Variant residues given in the sequence have no preference with respect to those in the annotations for variant positions"
GFTFSKNGMH

SEQ ID NO: 1033 - protein, 8 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  SITE (1)..(8): /note="Variant residues given in the sequence have no preference with respect to those in the annotations for variant positions"
GFTFSKNG

SEQ ID NO: 1034 - protein, 5 aa, Artificial Sequence
  source: /note="Description of Artificial Sequence: Synthetic peptide"
  VARIANT (2)..(2): /replace="Tyr" or "Gln"
  VARIANT (5)..(5): /replace="Ser"
  SITE (1)..(5): /note="Variant residues given in the sequence have no preference with respect to those in the annotations for variant positions"
KNGMH

SEQ ID NO: 1035 - protein, 7 aa, Artificial Sequence
  source: /note="Description of Artificial Sequence: Synthetic peptide"
  VARIANT (3)..(3): /replace="Ala"
  VARIANT (5)..(5): /replace="Arg"
  VARIANT (7)..(7): /replace="Tyr" or "Gln"
  SITE (1)..(7): /note="Variant residues given in the sequence have no preference with respect to those in the annotations for variant positions"
GFTFSKN

SEQ ID NO: 1036 - protein, 17 aa, Artificial Sequence
  source: /note="Description of Artificial Sequence: Synthetic peptide"
  VARIANT (1)..(1): /replace="Leu"
  VARIANT (8)..(8): /replace="Arg"
  SITE (1)..(17): /note="Variant residues given in the sequence have no preference with respect to those in the annotations for variant positions"
MIYYDSSKMYYADTVKG

SEQ ID NO: 1037 - protein, 6 aa, Artificial Sequence
  source: /note="Description of Artificial Sequence: Synthetic peptide"
  VARIANT (6)..(6): /replace="Arg"
  SITE (1)..(6): /note="Variant residues given in the sequence have no preference with respect to those in the annotations for variant positions"
YYDSSK

SEQ ID NO: 1038 - protein, 8 aa, Artificial Sequence
  source: /note="Description of Artificial Sequence: Synthetic peptide"
  VARIANT (7)..(7): /replace="Arg"
  SITE (1)..(8): /note="Variant residues given in the sequence have no preference with respect to those in the annotations for variant positions"
IYYDSSKM

SEQ ID NO: 1039 - protein, 9 aa, Artificial Sequence
  source: /note="Description of Artificial Sequence: Synthetic peptide"
  VARIANT (1)..(1): /replace="Tyr" or "Ser"
  VARIANT (2)..(2): /replace="Tyr" or "Ser" or "Thr"
  VARIANT (3)..(3): /replace="Tyr" or "Ser" or "Thr"
  VARIANT (9)..(9): /replace="Tyr"
  SITE (1)..(9): /note="Variant residues given in the sequence have no preference with respect to those in the annotations for variant positions"
FWWDLDFDH

SEQ ID NO: 1040 - protein, 11 aa, Artificial Sequence
  source: /note="Description of Artificial Sequence: Synthetic peptide"
  VARIANT (2)..(2): /replace="Lys"
  VARIANT (3)..(3): /replace="Tyr" or "Ser"
  VARIANT (4)..(4): /replace="Tyr" or "Ser" or "Thr"
  VARIANT (5)..(5): /replace="Tyr" or "Ser" or "Thr"
  VARIANT (11)..(11): /replace="Tyr"
  SITE (1)..(11): /note="Variant residues given in the sequence have no preference with respect to those in the annotations for variant positions"
ASFWWDLDFDH

SEQ ID NO: 1041 - protein, 8 aa, Artificial Sequence
  source: /note="Description of Artificial Sequence: Synthetic peptide"
AALNSEYD

SEQ ID NO: 1042 - protein, 6 aa, Artificial Sequence
  source: /note="Description of Artificial Sequence: Synthetic peptide"
LNSEYD

SEQ ID NO: 1043 - protein, 16 aa, Artificial Sequence
  source: /note="Description of Artificial Sequence: Synthetic peptide"
  VARIANT (2)..(2): /replace="Gly"
  VARIANT (6)..(6): /replace="Leu"
  VARIANT (7)..(7): /replace="Gly"
  VARIANT (8)..(8): /replace="Asn"
  VARIANT (10)..(10): /replace="Glu" or "Leu"
  VARIANT (11)..(11): /replace="Asn" or "Glu"
  SITE (1)..(16): /note="Variant residues given in the sequence have no preference with respect to those in the annotations for variant positions"
RSSQSIVRSDGTTYFN

SEQ ID NO: 1044 - protein, 10 aa, Artificial Sequence
  source: /note="Description of Artificial Sequence: Synthetic peptide"
  VARIANT (3)..(3): /replace="Leu"
  VARIANT (4)..(4): /replace="Gly"
  VARIANT (5)..(5): /replace="Asn"
  VARIANT (7)..(7): /replace="Glu" or "Leu"
  SITE (1)..(10): /note="Variant residues given in the sequence have no preference with respect to those in the annotations for variant positions"
QSIVRSDTTY

SEQ ID NO: 1045 - protein, 12 aa, Artificial Sequence
  source: /note="Description of Artificial Sequence: Synthetic peptide"
  VARIANT (4)..(4): /replace="Leu"
  VARIANT (5)..(5): /replace="Gly"
  VARIANT (6)..(6): /replace="Asn"
  VARIANT (8)..(8): /replace="Glu" or "Leu"
  VARIANT (9)..(9): /replace="Asn" or "Glu"
  SITE (1)..(12): /note="Variant residues given in the sequence have no preference with respect to those in the annotations for variant positions"
SQSIVRSDGTTY

SEQ ID NO: 1046 - protein, 11 aa, Artificial Sequence
  source: /note="Description of Artificial Sequence: Synthetic peptide"
  VARIANT (2)..(2): /replace="Gly"
  VARIANT (6)..(6): /replace="Leu"
  VARIANT (7)..(7): /replace="Gly"
  VARIANT (8)..(8): /replace="Asn"
  VARIANT (10)..(10): /replace="Glu" or "Leu"
  VARIANT (11)..(11): /replace="Asn" or "Glu"
  SITE (1)..(11): /note="Variant residues given in the sequence have no preference with respect to those in the annotations for variant positions"
RSSQSIVRSDG

SEQ ID NO: 1047 - protein, 7 aa, Artificial Sequence
  source: /note="Description of Artificial Sequence: Synthetic peptide"
  VARIANT (4)..(4): /replace="Leu"
  VARIANT (5)..(5): /replace="Gly"
  VARIANT (6)..(6): /replace="Asn"
  SITE (1)..(7): /note="Variant residues given in the sequence have no preference with respect to those in the annotations for variant positions"
SQSIVRS

SEQ ID NO: 1048 - protein, 6 aa, Artificial Sequence
  source: /note="Description of Artificial Sequence: Synthetic peptide"
  VARIANT (3)..(3): /replace="Leu"
  VARIANT (4)..(4): /replace="Gly"
  VARIANT (5)..(5): /replace="Asn"
  SITE (1)..(6): /note="Variant residues given in the sequence have no preference with respect to those in the annotations for variant positions"
QSIVRS

SEQ ID NO: 1049 - protein, 7 aa, Artificial Sequence
  source: /note="Description of Artificial Sequence: Synthetic peptide"
  VARIANT (1)..(1): /replace="Ser"
  VARIANT (2)..(2): /replace="Thr"
  VARIANT (4)..(4): /replace="Thr"
  VARIANT (5)..(5): /replace="Leu"
  VARIANT (6)..(6): /replace="Glu"
  VARIANT (7)..(7): /replace="Tyr"
  SITE (1)..(7): /note="Variant residues given in the sequence have no preference with respect to those in the annotations for variant positions"
RVSNRFS

SEQ ID NO: 1050 - protein, 3 aa, Artificial Sequence
  source: /note="Description of Artificial Sequence: Synthetic peptide"
  VARIANT (1)..(1): /replace="Ser"
  VARIANT (2)..(2): /replace="Thr"
  SITE (1)..(3): /note="Variant residues given in the sequence have no preference with respect to those in the annotations for variant positions"
RVS

SEQ ID NO: 1051 - protein, 9 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  VARIANT (6)..(6): /replace="Tyr"
  VARIANT (8)..(8): /replace="Tyr"
  SITE (1)..(9): /note="Variant residues given in the sequence have no preference with respect to those in the annotations for variant positions"
LQSSHFPWT

SEQ ID NO: 1052 - protein, 6 aa, Artificial Sequence
  source: /note="Description of Artificial Sequence: Synthetic peptide"
  VARIANT (1)..(1): /replace="Tyr"
  VARIANT (2)..(2): /replace="Ala"
  VARIANT (3)..(3): /replace="Thr"
  VARIANT (4)..(4): /replace="Tyr"
  VARIANT (6)..(6): /replace="Tyr"
  SITE (1)..(6): /note="Variant residues given in the sequence have no preference with respect to those in the annotations for variant positions"
SSHFPW

SEQ ID NO: 1053 - protein, 5 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  SITE (1)..(5): /note="Variant residues given in the sequence have no preference with respect to those in the annotations for variant positions"
LQSSH

SEQ ID NO: 1054 - protein, 8 aa, Artificial Sequence
  source: /note="Description of Artificial Sequence: Synthetic peptide"
  VARIANT (3)..(3): /replace="Tyr"
  VARIANT (4)..(4): /replace="Ala"
  VARIANT (5)..(5): /replace="Thr"
  VARIANT (6)..(6): /replace="Tyr"
  VARIANT (8)..(8): /replace="Tyr"
  SITE (1)..(8): /note="Variant residues given in the sequence have no preference with respect to those in the annotations for variant positions"
LQSSHFPW

SEQ ID NO: 1055 - protein, 10 aa, Artificial Sequence
  source: /note="Description of Artificial Sequence: Synthetic peptide"
  VARIANT (9)..(9): /replace="Ile"
  SITE (1)..(10): /note="Variant residues given in the sequence have no preference with respect to those in the annotations for variant positions"
GFSLTTYNVH

SEQ ID NO: 1056 - protein, 8 aa, Artificial Sequence
  source: /note="Description of Artificial Sequence: Synthetic peptide"
GFSLTTYN

SEQ ID NO: 1057 - protein, 5 aa, Artificial Sequence
  source: /note="Description of Artificial Sequence: Synthetic peptide"
  VARIANT (4)..(4): /replace="Ile"
  SITE (1)..(5): /note="Variant residues given in the sequence have no preference with respect to those in the annotations for variant positions"
TYNVH

SEQ ID NO: 1058 - protein, 7 aa, Artificial Sequence
  source: /note="Description of Artificial Sequence: Synthetic peptide"
GFSLTTY

SEQ ID NO: 1059 - protein, 16 aa, Artificial Sequence
  source: /note="Description of Artificial Sequence: Synthetic peptide"
  VARIANT (10)..(10): /replace="Tyr"
  VARIANT (11)..(11): /replace="Ser"
  VARIANT (12)..(12): /replace="Ser"
  VARIANT (15)..(15): /replace="Lys"
  SITE (1)..(16): /note="Variant residues given in the sequence have no preference with respect to those in the annotations for variant positions"
RMRYSGDTSFNAALTS

SEQ ID NO: 1060 - protein, 5 aa, Artificial Sequence
  source: /note="Description of Artificial Sequence: Synthetic peptide"
RYSGD

SEQ ID NO: 1061 - protein, 7 aa, Artificial Sequence
  source: /note="Description of Artificial Sequence: Synthetic peptide"
MRYSGDT

SEQ ID NO: 1062 - protein, 15 aa, Artificial Sequence
  source: /note="Description of Artificial Sequence: Synthetic peptide"
  VARIANT (7)..(7): /replace="Gly"
  VARIANT (9)..(9): /replace="Ala"
  SITE (1)..(15): /note="Variant residues given in the sequence have no preference with respect to those in the annotations for variant positions"
DPMYIPNYSYGVMNA

SEQ ID NO: 1063 - protein, 17 aa, Artificial Sequence
  source: /note="Description of Artificial Sequence: Synthetic peptide"
  VARIANT (1)..(1): /replace="Ala"
  VARIANT (2)..(2): /replace="Arg"
  VARIANT (9)..(9): /replace="Gly"
  VARIANT (11)..(11): /replace="Ala"
  SITE (1)..(17): /note="Variant residues given in the sequence have no preference with respect to those in the annotations for variant positions"
TSDPMYIPNYSYGVMNA

SEQ ID NO: 1064 - protein, 11 aa, Artificial Sequence
  source: /note="Description of Artificial Sequence: Synthetic peptide"
  VARIANT (2)..(2): /replace="Thr" or "Ser"
  VARIANT (7)..(7): /replace="Asp"
  VARIANT (8)..(8): /replace="Lys"
  SITE (1)..(11): /note="Variant residues given in the sequence have no preference with respect to those in the annotations for variant positions"
KASQNINNYLN

SEQ ID NO: 1065 - protein, 7 aa, Artificial Sequence
  source: /note="Description of Artificial Sequence: Synthetic peptide"
  VARIANT (5)..(5): /replace="Asp"
  VARIANT (6)..(6): /replace="Lys"
  SITE (1)..(7): /note="Variant residues given in the sequence have no preference with respect to those in the annotations for variant positions"
SQNINNY

SEQ ID NO: 1066 - protein, 6 aa, Artificial Sequence
  source: /note="Description of Artificial Sequence: Synthetic peptide"
  VARIANT (4)..(4): /replace="Asp"
  VARIANT (5)..(5): /replace="Lys"
  SITE (1)..(6): /note="Variant residues given in the sequence have no preference with respect to those in the annotations for variant positions"
QNINNY

SEQ ID NO: 1067 - protein, 10 aa, Artificial Sequence
  source: /note="Description of Artificial Sequence: Synthetic peptide"
  VARIANT (3)..(3): /replace="Asn"
  VARIANT (4)..(4): /replace="Asn"
  VARIANT (6)..(6): /replace="Glu"
  SITE (1)..(10): /note="Variant residues given in the sequence have no preference with respect to those in the annotations for variant positions"
NTDHLQAGVP

SEQ ID NO: 1068 - protein, 7 aa, Artificial Sequence
  source: /note="Description of Artificial Sequence: Synthetic peptide"
  VARIANT (3)..(3): /replace="Asn"
  VARIANT (4)..(4): /replace="Asn"
  VARIANT (6)..(6): /replace="Glu"
  SITE (1)..(7): /note="Variant residues given in the sequence have no preference with respect to those in the annotations for variant positions"
NTDHLQA

SEQ ID NO: 1069 - protein, 3 aa, Artificial Sequence
  source: /note="Description of Artificial Sequence: Synthetic peptide"
  VARIANT (3)..(3): /replace="Asn"
  SITE (1)..(3): /note="Variant residues given in the sequence have no preference with respect to those in the annotations for variant positions"
NTD

SEQ ID NO: 1070 - protein, 8 aa, Artificial Sequence
  source: /note="Description of Artificial Sequence: Synthetic peptide"
  VARIANT (6)..(6): /replace="Ser" or "Gly"
  SITE (1)..(8): /note="Variant residues given in the sequence have no preference with respect to those in the annotations for variant positions"
LQHRSRYT

SEQ ID NO: 1071 - protein, 5 aa, Artificial Sequence
  source: /note="Description of Artificial Sequence: Synthetic peptide"
  VARIANT (4)..(4): /replace="Ser" or "Gly"
  SITE (1)..(5): /note="Variant residues given in the sequence have no preference with respect to those in the annotations for variant positions"
HRSRY

SEQ ID NO: 1072 - protein, 10 aa, Artificial Sequence
  source: /note="Description of Artificial Sequence: Synthetic peptide"
GYTFTSYYIY

SEQ ID NO: 1073 - protein, 8 aa, Artificial Sequence
  source: /note="Description of Artificial Sequence: Synthetic peptide"
GYTFTSYY

SEQ ID NO: 1074 - protein, 5 aa, Artificial Sequence
  source: /note="Description of Artificial Sequence: Synthetic peptide"
SYYIY

SEQ ID NO: 1075 - protein, 17 aa, Artificial Sequence
  source: /note="Description of Artificial Sequence: Synthetic peptide"
  VARIANT (5)..(5): /replace="Ala"
  VARIANT (6)..(6): /replace="Asn"
  VARIANT (7)..(7): /replace="Gly"
  VARIANT (8)..(8): /replace="Gly"
  VARIANT (14)..(14): /replace="Lys"
  SITE (1)..(17): /note="Variant residues given in the sequence have no preference with respect to those in the annotations for variant positions"
YIYPGHDAIYYSENFKG

SEQ ID NO: 1076 - protein, 6 aa, Artificial Sequence
  source: /note="Description of Artificial Sequence: Synthetic peptide"
  VARIANT (3)..(3): /replace="Ala"
  VARIANT (4)..(4): /replace="Asn"
  VARIANT (5)..(5): /replace="Gly"
  VARIANT (6)..(6): /replace="Gly"
  SITE (1)..(6): /note="Variant residues given in the sequence have no preference with respect to those in the annotations for variant positions"
YPGHDA

SEQ ID NO: 1077 - protein, 8 aa, Artificial Sequence
  source: /note="Description of Artificial Sequence: Synthetic peptide"
  VARIANT (4)..(4): /replace="Ala"
  VARIANT (5)..(5): /replace="Asn"
  VARIANT (6)..(6): /replace="Gly"
  VARIANT (7)..(7): /replace="Gly"
  SITE (1)..(8): /note="Variant residues given in the sequence have no preference with respect to those in the annotations for variant positions"
IYPGHDAI

SEQ ID NO: 1078 - protein, 12 aa, Artificial Sequence
  source: /note="Description of Artificial Sequence: Synthetic peptide"
  VARIANT (1)..(1): /replace="Ala"
  VARIANT (4)..(4): /replace="Val"
  VARIANT (11)..(11): /replace="Val"
  VARIANT (12)..(12): /replace="Phe"
  SITE (1)..(12): /note="Variant residues given in the sequence have no preference with respect to those in the annotations for variant positions"
VRPNTMMAPLAY

SEQ ID NO: 1079 - protein, 10 aa, Artificial Sequence
  source: /note="Description of Artificial Sequence: Synthetic peptide"
  VARIANT (2)..(2): /replace="Val"
  VARIANT (9)..(9): /replace="Val"
  VARIANT (10)..(10): /replace="Phe"
  SITE (1)..(10): /note="Variant residues given in the sequence have no preference with respect to those in the annotations for variant positions"
PNTMMAPLAY

SEQ ID NO: 1080 - protein, 16 aa, Artificial Sequence
  source: /note="Description of Artificial Sequence: Synthetic peptide"
  VARIANT (7)..(7): /replace="Val"
  VARIANT (10)..(10): /replace="His"
  SITE (1)..(16): /note="Variant residues given in the sequence have no preference with respect to those in the annotations for variant positions"
RSSQSLIYSIGNTYLH

SEQ ID NO: 1081 - protein, 12 aa, Artificial Sequence
  source: /note="Description of Artificial Sequence: Synthetic peptide"
  VARIANT (5)..(5): /replace="Val"
  VARIANT (8)..(8): /replace="His"
  SITE (1)..(12): /note="Variant residues given in the sequence have no preference with respect to those in the annotations for variant positions"
SQSLIYSIGNTY

SEQ ID NO: 1082 - protein, 11 aa, Artificial Sequence
  source: /note="Description of Artificial Sequence: Synthetic peptide"
  VARIANT (4)..(4): /replace="Val"
  VARIANT (7)..(7): /replace="His"
  SITE (1)..(11): /note="Variant residues given in the sequence have no preference with respect to those in the annotations for variant positions"
QSLIYSIGNTY

SEQ ID NO: 1083 - protein, 7 aa, Artificial Sequence
  source: /note="Description of Artificial Sequence: Synthetic peptide"
RVSNRFS

SEQ ID NO: 1084 - protein, 3 aa, Artificial Sequence
  source: /note="Description of Artificial Sequence: Synthetic peptide"
RVS

SEQ ID NO: 1085 - protein, 9 aa, Artificial Sequence
  source: /note="Description of Artificial Sequence: Synthetic peptide"
FQSTHLPYT

SEQ ID NO: 1086 - protein, 6 aa, Artificial Sequence
  source: /note="Description of Artificial Sequence: Synthetic peptide"
STHLPY

SEQ ID NO: 1087 - protein, 5 aa, Artificial Sequence
  source: /note="Description of Artificial Sequence: Synthetic peptide"
KNGMH

SEQ ID NO: 1088 - protein, 5 aa, Artificial Sequence
  source: /note="Description of Artificial Sequence: Synthetic peptide"
TYNVH

SEQ ID NO: 1089 - protein, 5 aa, Artificial Sequence
  source: /note="Description of Artificial Sequence: Synthetic peptide"
TYNIH

SEQ ID NO: 1090 - protein, 5 aa, Artificial Sequence
  source: /note="Description of Artificial Sequence: Synthetic peptide"
KYGMS

SEQ ID NO: 1091 - protein, 5 aa, Artificial Sequence
  source: /note="Description of Artificial Sequence: Synthetic peptide"
KQGMH

SEQ ID NO: 1092 - protein, 5 aa, Artificial Sequence
  source: /note="Description of Artificial Sequence: Synthetic peptide"
KNQMH

SEQ ID NO: 1093 - protein, 17 aa, Artificial Sequence
  source: /note="Description of Artificial Sequence: Synthetic peptide"
MIYYDSSKMYYADTVKG

SEQ ID NO: 1094 - protein, 17 aa, Artificial Sequence
  source: /note="Description of Artificial Sequence: Synthetic peptide"
YIYPGHDAIYYSENFKG

SEQ ID NO: 1095 - protein, 16 aa, Artificial Sequence
  source: /note="Description of Artificial Sequence: Synthetic peptide"
RMRYSGDTSFNAALTS

SEQ ID NO: 1096 - protein, 17 aa, Artificial Sequence
  source: /note="Description of Artificial Sequence: Synthetic peptide"
YIYPANGGIYYSEKFKG

SEQ ID NO: 1097 - protein, 17 aa, Artificial Sequence
  source: /note="Description of Artificial Sequence: Synthetic peptide"
MIYYDSSRMYYADTVKG

SEQ ID NO: 1098 - protein, 16 aa, Artificial Sequence
  source: /note="Description of Artificial Sequence: Synthetic peptide"
RMRYSGDTSYSSALKS

SEQ ID NO: 1099 - protein, 17 aa, Artificial Sequence
  source: /note="Description of Artificial Sequence: Synthetic peptide"
LIYYDSSKMNYADTVKG

SEQ ID NO: 1100 - protein, 9 aa, Artificial Sequence
  source: /note="Description of Artificial Sequence: Synthetic peptide"
FWWDLDFDH

SEQ ID NO: 1101 - protein, 10 aa, Artificial Sequence
  source: /note="Description of Artificial Sequence: Synthetic peptide"
PNTMMAPLAY

SEQ ID NO: 1102 - protein, 15 aa, Artificial Sequence
  source: /note="Description of Artificial Sequence: Synthetic peptide"
DPMYIPNYSYGVMNA

SEQ ID NO: 1103 - protein, 10 aa, Artificial Sequence
  source: /note="Description of Artificial Sequence: Synthetic peptide"
PVTMMAPLVF

SEQ ID NO: 1104 - protein, 9 aa, Artificial Sequence
  source: /note="Description of Artificial Sequence: Synthetic peptide"
FWWDLDFDY

SEQ ID NO: 1105 - protein, 15 aa, Artificial Sequence
  source: /note="Description of Artificial Sequence: Synthetic peptide"
DPMYIPGYSYGVMNA

SEQ ID NO: 1106 - protein, 9 aa, Artificial Sequence
  source: /note="Description of Artificial Sequence: Synthetic peptide"
FYYDLDFDH

SEQ ID NO: 1107 - protein, 9 aa, Artificial Sequence
  source: /note="Description of Artificial Sequence: Synthetic peptide"
FSSDLDFDH

SEQ ID NO: 1108 - protein, 9 aa, Artificial Sequence
  source: /note="Description of Artificial Sequence: Synthetic peptide"
FWSDLDFDH

SEQ ID NO: 1109 - protein, 9 aa, Artificial Sequence
  source: /note="Description of Artificial Sequence: Synthetic peptide"
FSWDLDFDH

SEQ ID NO: 1110 - protein, 9 aa, Artificial Sequence
  source: /note="Description of Artificial Sequence: Synthetic peptide"
FTTDLDFDH

SEQ ID NO: 1111 - protein, 9 aa, Artificial Sequence
  source: /note="Description of Artificial Sequence: Synthetic peptide"
FTWDLDFDH

SEQ ID NO: 1112 - protein, 9 aa, Artificial Sequence
  source: /note="Description of Artificial Sequence: Synthetic peptide"
FWTDLDFDH

SEQ ID NO: 1113 - protein, 15 aa, Artificial Sequence
  source: /note="Description of Artificial Sequence: Synthetic peptide"
DPMYIPNYAYGVMNA

SEQ ID NO: 1114 - protein, 9 aa, Artificial Sequence
  source: /note="Description of Artificial Sequence: Synthetic peptide"
YYYDLDFDH

SEQ ID NO: 1115 - protein, 9 aa, Artificial Sequence
  source: /note="Description of Artificial Sequence: Synthetic peptide"
SYYDLDFDH

SEQ ID NO: 1116 - protein, 9 aa, Artificial Sequence
  source: /note="Description of Artificial Sequence: Synthetic peptide"
YSSDLDFDH

SEQ ID NO: 1117 - protein, 9 aa, Artificial Sequence
  source: /note="Description of Artificial Sequence: Synthetic peptide"
SSSDLDFDH

SEQ ID NO: 1118 - protein, 9 aa, Artificial Sequence
  source: /note="Description of Artificial Sequence: Synthetic peptide"
YWSDLDFDH

SEQ ID NO: 1119 - protein, 9 aa, Artificial Sequence
  source: /note="Description of Artificial Sequence: Synthetic peptide"
SWSDLDFDH

SEQ ID NO: 1120 - protein, 9 aa, Artificial Sequence
  source: /note="Description of Artificial Sequence: Synthetic peptide"
YSWDLDFDH

SEQ ID NO: 1121 - protein, 9 aa, Artificial Sequence
  source: /note="Description of Artificial Sequence: Synthetic peptide"
SSWDLDFDH

SEQ ID NO: 1122 - protein, 9 aa, Artificial Sequence
  source: /note="Description of Artificial Sequence: Synthetic peptide"
YTWDLDFDH

SEQ ID NO: 1123 - protein, 9 aa, Artificial Sequence
  source: /note="Description of Artificial Sequence: Synthetic peptide"
STWDLDFDH

SEQ ID NO: 1124 - protein, 9 aa, Artificial Sequence
  source: /note="Description of Artificial Sequence: Synthetic peptide"
YTTDLDFDH

SEQ ID NO: 1125 - protein, 9 aa, Artificial Sequence
  source: /note="Description of Artificial Sequence: Synthetic peptide"
STTDLDFDH

SEQ ID NO: 1126 - protein, 9 aa, Artificial Sequence
  source: /note="Description of Artificial Sequence: Synthetic peptide"
YWWDLDFDH

SEQ ID NO: 1127 - protein, 9 aa, Artificial Sequence
  source: /note="Description of Artificial Sequence: Synthetic peptide"
SWWDLDFDH

SEQ ID NO: 1128 - protein, 16 aa, Artificial Sequence
  source: /note="Description of Artificial Sequence: Synthetic peptide"
RSSQSLVRSDGTTYFN

SEQ ID NO: 1129 - protein, 16 aa, Artificial Sequence
  source: /note="Description of Artificial Sequence: Synthetic peptide"
RSSQSLIYSIGNTYLH

SEQ ID NO: 1130 - protein, 11 aa, Artificial Sequence
  source: /note="Description of Artificial Sequence: Synthetic peptide"
KASQNINNYLN

SEQ ID NO: 1131 - protein, 16 aa, Artificial Sequence
  source: /note="Description of Artificial Sequence: Synthetic peptide"
RSSQSLVYSHGNTYLH

SEQ ID NO: 1132 - protein, 11 aa, Artificial Sequence
  source: /note="Description of Artificial Sequence: Synthetic peptide"
KTSQNIDKYLN

SEQ ID NO: 1133 - protein, 11 aa, Artificial Sequence
  source: /note="Description of Artificial Sequence: Synthetic peptide"
RGSQSIGNSLN

SEQ ID NO: 1134 - protein, 11 aa, Artificial Sequence
  source: /note="Description of Artificial Sequence: Synthetic peptide"
KSSQNIDKYLN

SEQ ID NO: 1135 - protein, 16 aa, Artificial Sequence
  source: /note="Description of Artificial Sequence: Synthetic peptide"
RSSQSLVRSEGTTYFN

SEQ ID NO: 1136 - protein, 7 aa, Artificial Sequence
  source: /note="Description of Artificial Sequence: Synthetic peptide"
NTDHLQA

SEQ ID NO: 1137 - protein, 7 aa, Artificial Sequence
  source: /note="Description of Artificial Sequence: Synthetic peptide"
NTNNLEA

SEQ ID NO: 1138 - protein, 7 aa, Artificial Sequence
  source: /note="Description of Artificial Sequence: Synthetic peptide"
STSTLEY

SEQ ID NO: 1139 - protein, 9 aa, Artificial Sequence
  source: /note="Description of Artificial Sequence: Synthetic peptide"
LQSSHFPWT

SEQ ID NO: 1140 - protein, 8 aa, Artificial Sequence
  source: /note="Description of Artificial Sequence: Synthetic peptide"
LQHRSRYT

SEQ ID NO: 1141 - protein, 8 aa, Artificial Sequence
  source: /note="Description of Artificial Sequence: Synthetic peptide"
LQHRSSYT

SEQ ID NO: 1142 - protein, 9 aa, Artificial Sequence
  source: /note="Description of Artificial Sequence: Synthetic peptide"
LQYATYPYT

SEQ ID NO: 1143 - protein, 8 aa, Artificial Sequence
  source: /note="Description of Artificial Sequence: Synthetic peptide"
LQHRSGYT

SEQ ID NO: 1144 - protein, 5 aa, Artificial Sequence
  source: /note="Description of Artificial Sequence: Synthetic peptide"
LQSSH

SEQ ID NO: 1145 - protein, 7 aa, Artificial Sequence
  source: /note="Description of Artificial Sequence: Synthetic peptide"
GFTFSKN

SEQ ID NO: 1146 - protein, 7 aa, Artificial Sequence
  source: /note="Description of Artificial Sequence: Synthetic peptide"
GFAFRKY

SEQ ID NO: 1147 - protein, 7 aa, Artificial Sequence
  source: /note="Description of Artificial Sequence: Synthetic peptide"
GFTFSKQ

SEQ ID NO: 1148 - protein, 6 aa, Artificial Sequence
  source: /note="Description of Artificial Sequence: Synthetic peptide"
YYDSSK

SEQ ID NO: 1149 - protein, 6 aa, Artificial Sequence
  source: /note="Description of Artificial Sequence: Synthetic peptide"
YPGHDA

SEQ ID NO: 1150 - protein, 6 aa, Artificial Sequence
  source: /note="Description of Artificial Sequence: Synthetic peptide"
YPANGG

SEQ ID NO: 1151 - protein, 6 aa, Artificial Sequence
  source: /note="Description of Artificial Sequence: Synthetic peptide"
YYDSSR

SEQ ID NO: 1152 - protein, 12 aa, Artificial Sequence
  source: /note="Description of Artificial Sequence: Synthetic peptide"
SQSLVRSDGTTY

SEQ ID NO: 1153 - protein, 12 aa, Artificial Sequence
  source: /note="Description of Artificial Sequence: Synthetic peptide"
SQSLIYSIGNTY

SEQ ID NO: 1154 - protein, 7 aa, Artificial Sequence
  source: /note="Description of Artificial Sequence: Synthetic peptide"
SQNINNY

SEQ ID NO: 1155 - protein, 12 aa, Artificial Sequence
  source: /note="Description of Artificial Sequence: Synthetic peptide"
SQSLVYSHGNTY

SEQ ID NO: 1156 - protein, 7 aa, Artificial Sequence
  source: /note="Description of Artificial Sequence: Synthetic peptide"
SQNIDKY

SEQ ID NO: 1157 - protein, 7 aa, Artificial Sequence
  source: /note="Description of Artificial Sequence: Synthetic peptide"
SQSIGNS

SEQ ID NO: 1158 - protein, 12 aa, Artificial Sequence
  source: /note="Description of Artificial Sequence: Synthetic peptide"
SQSLVRSEGTTY

SEQ ID NO: 1159 - protein, 3 aa, Artificial Sequence
  source: /note="Description of Artificial Sequence: Synthetic peptide"
NTD

SEQ ID NO: 1160 - protein, 3 aa, Artificial Sequence
  source: /note="Description of Artificial Sequence: Synthetic peptide"
NTN

SEQ ID NO: 1161 - protein, 3 aa, Artificial Sequence
  source: /note="Description of Artificial Sequence: Synthetic peptide"
STS

SEQ ID NO: 1162 - protein, 6 aa, Artificial Sequence
  source: /note="Description of Artificial Sequence: Synthetic peptide"
SSHFPW

SEQ ID NO: 1163 - protein, 5 aa, Artificial Sequence
  source: /note="Description of Artificial Sequence: Synthetic peptide"
HRSRY

SEQ ID NO: 1164 - protein, 5 aa, Artificial Sequence
  source: /note="Description of Artificial Sequence: Synthetic peptide"
HRSSY

SEQ ID NO: 1165 - protein, 6 aa, Artificial Sequence
  source: /note="Description of Artificial Sequence: Synthetic peptide"
YATYPY

SEQ ID NO: 1166 - protein, 5 aa, Artificial Sequence
  source: /note="Description of Artificial Sequence: Synthetic peptide"
HRSGY

SEQ ID NO: 1167 - protein, 8 aa, Artificial Sequence
  source: /note="Description of Artificial Sequence: Synthetic peptide"
GFTFSKNG

SEQ ID NO: 1168 - protein, 8 aa, Artificial Sequence
  source: /note="Description of Artificial Sequence: Synthetic peptide"
GFAFRKYG

SEQ ID NO: 1169 - protein, 8 aa, Artificial Sequence
  source: /note="Description of Artificial Sequence: Synthetic peptide"
GFTFSKQG

SEQ ID NO: 1170 - protein, 8 aa, Artificial Sequence
  source: /note="Description of Artificial Sequence: Synthetic peptide"
IYYDSSKM

SEQ ID NO: 1171 - protein, 8 aa, Artificial Sequence
  source: /note="Description of Artificial Sequence: Synthetic peptide"
IYPGHDAI

SEQ ID NO: 1172 - protein, 8 aa, Artificial Sequence
  source: /note="Description of Artificial Sequence: Synthetic peptide"
IYPANGGI

SEQ ID NO: 1173 - protein, 8 aa, Artificial Sequence
  source: /note="Description of Artificial Sequence: Synthetic peptide"
IYYDSSRM

SEQ ID NO: 1174 - protein, 11 aa, Artificial Sequence
  source: /note="Description of Artificial Sequence: Synthetic peptide"
ASFWWDLDFDH

SEQ ID NO: 1175 - protein, 12 aa, Artificial Sequence
  source: /note="Description of Artificial Sequence: Synthetic peptide"
VRPNTMMAPLAY

SEQ ID NO: 1176 - protein, 17 aa, Artificial Sequence
  source: /note="Description of Artificial Sequence: Synthetic peptide"
TSDPMYIPNYSYGVMNA

SEQ ID NO: 1177 - protein, 17 aa, Artificial Sequence
  source: /note="Description of Artificial Sequence: Synthetic peptide"
ARDPMYIPNYSYGVMNA

SEQ ID NO: 1178 - protein, 12 aa, Artificial Sequence
  source: /note="Description of Artificial Sequence: Synthetic peptide"
ARPVTMMAPLVF

SEQ ID NO: 1179 - protein, 11 aa, Artificial Sequence
  source: /note="Description of Artificial Sequence: Synthetic peptide"
ASFWWDLDFDY

SEQ ID NO: 1180 - protein, 17 aa, Artificial Sequence
  source: /note="Description of Artificial Sequence: Synthetic peptide"
TRDPMYIPGYSYGVMNA

SEQ ID NO: 1181 - protein, 11 aa, Artificial Sequence
  source: /note="Description of Artificial Sequence: Synthetic peptide"
AKFWWDLDFDH

SEQ ID NO: 1182 - protein, 11 aa, Artificial Sequence
  source: /note="Description of Artificial Sequence: Synthetic peptide"
ASFYYDLDFDH

SEQ ID NO: 1183 - protein, 11 aa, Artificial Sequence
  source: /note="Description of Artificial Sequence: Synthetic peptide"
ASFSSDLDFDH

SEQ ID NO: 1184 - protein, 11 aa, Artificial Sequence
  source: /note="Description of Artificial Sequence: Synthetic peptide"
ASFWSDLDFDH

SEQ ID NO: 1185 - protein, 11 aa, Artificial Sequence
  source: /note="Description of Artificial Sequence: Synthetic peptide"
ASFSWDLDFDH

SEQ ID NO: 1186 - protein, 11 aa, Artificial Sequence
  source: /note="Description of Artificial Sequence: Synthetic peptide"
ASFTTDLDFDH

SEQ ID NO: 1187 - protein, 11 aa, Artificial Sequence
  source: /note="Description of Artificial Sequence: Synthetic peptide"
ASFTWDLDFDH

SEQ ID NO: 1188 - protein, 11 aa, Artificial Sequence
  source: /note="Description of Artificial Sequence: Synthetic peptide"
ASFWTDLDFDH

SEQ ID NO: 1189 - protein, 17 aa, Artificial Sequence
  source: /note="Description of Artificial Sequence: Synthetic peptide"
ASDPMYIPNYAYGVMNA

SEQ ID NO: 1190 - protein, 11 aa, Artificial Sequence
  source: /note="Description of Artificial Sequence: Synthetic peptide"
ASYYYDLDFDH

SEQ ID NO: 1191 - protein, 11 aa, Artificial Sequence
  source: /note="Description of Artificial Sequence: Synthetic peptide"
ASSYYDLDFDH

SEQ ID NO: 1192 - protein, 11 aa, Artificial Sequence
  source: /note="Description of Artificial Sequence: Synthetic peptide"
ASYSSDLDFDH

SEQ ID NO: 1193 - protein, 11 aa, Artificial Sequence
  source: /note="Description of Artificial Sequence: Synthetic peptide"
ASSSSDLDFDH

SEQ ID NO: 1194 - protein, 11 aa, Artificial Sequence
  source: /note="Description of Artificial Sequence: Synthetic peptide"
ASYWSDLDFDH

SEQ ID NO: 1195 - protein, 11 aa, Artificial Sequence
  source: /note="Description of Artificial Sequence: Synthetic peptide"
ASSWSDLDFDH

SEQ ID NO: 1196 - protein, 11 aa, Artificial Sequence
  source: /note="Description of Artificial Sequence: Synthetic peptide"
ASYSWDLDFDH

SEQ ID NO: 1197 - protein, 11 aa, Artificial Sequence
  source: /note="Description of Artificial Sequence: Synthetic peptide"
ASSSWDLDFDH

SEQ ID NO: 1198 - protein, 11 aa, Artificial Sequence
  source: /note="Description of Artificial Sequence: Synthetic peptide"
ASYTWDLDFDH

SEQ ID NO: 1199 - protein, 11 aa, Artificial Sequence
  source: /note="Description of Artificial Sequence: Synthetic peptide"
ASSTWDLDFDH

SEQ ID NO: 1200 - protein, 11 aa, Artificial Sequence
  source: /note="Description of Artificial Sequence: Synthetic peptide"
ASYTTDLDFDH

SEQ ID NO: 1201 - protein, 11 aa, Artificial Sequence
  source: /note="Description of Artificial Sequence: Synthetic peptide"
ASSTTDLDFDH

SEQ ID NO: 1202 - protein, 11 aa, Artificial Sequence
  source: /note="Description of Artificial Sequence: Synthetic peptide"
ASYWWDLDFDH

SEQ ID NO: 1203 - protein, 11 aa, Artificial Sequence
  source: /note="Description of Artificial Sequence: Synthetic peptide"
ASSWWDLDFDH

SEQ ID NO: 1204 - protein, 11 aa, Artificial Sequence
  source: /note="Description of Artificial Sequence: Synthetic peptide"
QSLVRSDGTTY

SEQ ID NO: 1205 - protein, 11 aa, Artificial Sequence
  source: /note="Description of Artificial Sequence: Synthetic peptide"
QSLIYSIGNTY

SEQ ID NO: 1206 - protein, 6 aa, Artificial Sequence
  source: /note="Description of Artificial Sequence: Synthetic peptide"
QNINNY

SEQ ID NO: 1207 - protein, 11 aa, Artificial Sequence
  source: /note="Description of Artificial Sequence: Synthetic peptide"
QSLVYSHGNTY

SEQ ID NO: 1208 - protein, 6 aa, Artificial Sequence
  source: /note="Description of Artificial Sequence: Synthetic peptide"
QNIDKY

SEQ ID NO: 1209 - protein, 6 aa, Artificial Sequence
  source: /note="Description of Artificial Sequence: Synthetic peptide"
QSIGNS

SEQ ID NO: 1210 - protein, 11 aa, Artificial Sequence
  source: /note="Description of Artificial Sequence: Synthetic peptide"
QSLVRSEGTTY

SEQ ID NO: 1211 - protein, 11 aa, Artificial Sequence
  source: /note="Description of Artificial Sequence: Synthetic peptide"
QSLVRSDETTY

SEQ ID NO: 1212 - protein, 10 aa, Artificial Sequence
  source: /note="Description of Artificial Sequence: Synthetic peptide"
NTDHLQAGVP

SEQ ID NO: 1213 - protein, 10 aa, Artificial Sequence
  source: /note="Description of Artificial Sequence: Synthetic peptide"
NTNNLEAGVP

SEQ ID NO: 1214 - protein, 10 aa, Artificial Sequence
  source: /note="Description of Artificial Sequence: Synthetic peptide"
STSTLEYGVP

SEQ ID NO: 1215 - protein, 10 aa, Artificial Sequence
  source: /note="Description of Artificial Sequence: Synthetic peptide"
GFTFSKNGMH

SEQ ID NO: 1216 - protein, 10 aa, Artificial Sequence
  source: /note="Description of Artificial Sequence: Synthetic peptide"
GFSLTTYNVH

SEQ ID NO: 1217 - protein, 10 aa, Artificial Sequence
  source: /note="Description of Artificial Sequence: Synthetic peptide"
GFSLTTYNIH

SEQ ID NO: 1218 - protein, 10 aa, Artificial Sequence
  source: /note="Description of Artificial Sequence: Synthetic peptide"
GFAFRKYGMS

SEQ ID NO: 1219 - protein, 10 aa, Artificial Sequence
  source: /note="Description of Artificial Sequence: Synthetic peptide"
GFTFSKQGMH

SEQ ID NO: 1220 - protein, 8 aa, Artificial Sequence
  source: /note="Description of Artificial Sequence: Synthetic peptide"
LQSSHFPW

SEQ ID NO: 1221 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWWDLDFDHWGQGTMVTVSS

SEQ ID NO: 1222 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPGHDAIYYSENFKGRVTITADTSASTAYMELSSLRSEDTAVYYCVRPNTMMAPLAYWGQGTLVTVSS

SEQ ID NO: 1223 - protein, 119 aa, Artificial Sequence
  source: /note="Description of Artificial Sequence: Synthetic polypeptide"
QVQLHQSGAELAKPGTSVNLSCKASGYTFTSYYIYWIKRRPGQGLEWIGYIYPGHDAIYYSENFKGKATFTADTSSSTAYMLLGSLTPEDSAYYFCVRPNTMMAPLAYWGQGTLVTVSS

SEQ ID NO: 1224 - protein, 123 aa, Artificial Sequence
  source: /note="Description of Artificial Sequence: Synthetic polypeptide"
QVQLQESGPGLVKPSETLSLTCTVSGFSLTTYNVHWIRQPPGKGLEWIGRMRYSGDTSFNAALTSRVTISRDTSKNQVSLKLSSVTAADTAVYYCTSDPMYIPNYSYGVMNAWGQGTTVTVSS

SEQ ID NO: 1225 - protein, 123 aa, Artificial Sequence
  source: /note="Description of Artificial Sequence: Synthetic polypeptide"
QVQLQESGPGLVKPSETLSLTCTVSGFSLTTYNVHWIRQPPGKGLEWIGRMRYSGDTSFNAALTSRVTISVDTSKNQFSLKLSSVTAADTAVYYCARDPMYIPNYSYGVMNAWGQGTTVTVSS

SEQ ID NO: 1226 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPANGGIYYSEKFKGRVTITADTSAGTAYMELSSLRSEDTAVYYCARPVTMMAPLVFWGQGTLVTVSS

SEQ ID NO: 1227 - protein, 119 aa, Artificial Sequence
  source: /note="Description of Artificial Sequence: Synthetic polypeptide"
QVQLVQSGAEVKKPGASVKVSCKASGYTFTSYYIYWVRQAPGQRLEWMGYIYPANGGIYYSEKFKGRVTITRDTSASTAYMELSSLRSEDTAVYYCARPVTMMAPLVFWGQGTLVTVSS

SEQ ID NO: 1228 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSRMYYADTVKGRFTISRDNSKNTLYLQMNSLRAEDTAVYYCASFWWDLDFDYWGQGTMVTVSS

SEQ ID NO: 1229 - protein, 123 aa, Artificial Sequence
  source: /note="Description of Artificial Sequence: Synthetic polypeptide"
QVQLQESGPGLVKPSETLSLTCTVSGFSLTTYNIHWIRQPPGKGLEWIGRMRYSGDTSYSSALKSRVTISRDTSKNQVSLKLSSVTAADTAVYYCTRDPMYIPGYSYGVMNAWGQGTTVTVSS

SEQ ID NO: 1230 - protein, 115 aa, Artificial Sequence
  source: /note="Description of Artificial Sequence: Synthetic polypeptide"
QVQLVESGGGVVQPGRSLRLSCAASGFAFRKYGMSWVRQAPGKGLEWVALIYYDSSKMNYADTVKGRFTISRDNSKNTLYLQMNSLRAEDTAVYYCAALNSEYDWGQGTMVTVSS

SEQ ID NO: 1231 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCAKFWWDLDFDHWGQGTMVTVSS

SEQ ID NO: 1232 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFWWDLDFDHWGQGTMVTVSS

SEQ ID NO: 1233 - protein, 118 aa, Artificial Sequence
  source: /note="Description of Artificial Sequence: Synthetic polypeptide"
EVKLVESGGDLVQPGDSLTLSCVASGFTFSKQGMHWIRQAPKKGLEWIAMIYYDSSKMYYADTVKGRFTISRDNSKNTLYLEMNSLRSEDTAMYYCASFWWDLDFDHWGQGVMVTVSS

SEQ ID NO: 1234 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFYYDLDFDHWGQGTMVTVSS

SEQ ID NO: 1235 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSSDLDFDHWGQGTMVTVSS

SEQ ID NO: 1236 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWSDLDFDHWGQGTMVTVSS

SEQ ID NO: 1237 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFSWDLDFDHWGQGTMVTVSS

SEQ ID NO: 1238 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFTTDLDFDHWGQGTMVTVSS

SEQ ID NO: 1239 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFTWDLDFDHWGQGTMVTVSS

SEQ ID NO: 1240 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASFWTDLDFDHWGQGTMVTVSS

SEQ ID NO: 1241 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFWWDLDFDHWGQGTMVTVSS

SEQ ID NO: 1242 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFWWDLDFDHWGQGTMVTVSS

SEQ ID NO: 1243 - protein, 123 aa, Artificial Sequence
  source: /note="Description of Artificial Sequence: Synthetic polypeptide"
EVQLVESGGGLVQPGGSLRLSCAASGFSLTTYNVHWVRQAPGKGLEWVGRMRYSGDTSFNAALTSRFTISRDNSKNTLYLQMNSLRAEDTAVYYCASDPMYIPNYAYGVMNAWGQGTLVTVSS

SEQ ID NO: 1244 - protein, 123 aa, Artificial Sequence
  source: /note="Description of Artificial Sequence: Synthetic polypeptide"
EVQLVETGGGLVQPGGSRRLSCAASGFSLTTYNVHWVRQAPGKGLEWVGRMRYSGDTSFNAALTSRFTISRDTSKNTVYLQMNSLRAEDTGVYYCASDPMYIPNYAYGVMNAWGQGTLVTVSS

SEQ ID NO: 1245 - protein, 123 aa, Artificial Sequence
  source: /note="Description of Artificial Sequence: Synthetic polypeptide"
EVQLVETGGGLVQPGGSRRLSCAASGFSLTTYNVHWVRQAPGKGLEWVSRMRYSGDTSFNAALTSRFTISRDTSKNTVYLQMNSLRAEDTGVYYCASDPMYIPNYAYGVMNAWGQGTLVTVSS

SEQ ID NO: 1246 - protein, 122 aa, Artificial Sequence
  source: /note="Description of Artificial Sequence: Synthetic polypeptide"
VQLVESGGGLVQPGGSLRLSCAASGFSLTTYNVHWVRQAPGKGLEWVSRMRYSGDTSFNAALTSRFTISRDNSKNTLYLQMNSLRAEDTAVYYCASDPMYIPNYAYGVMNAWGQGTLVTVSS

SEQ ID NO: 1247 - protein, 123 aa, Artificial Sequence
  source: /note="Description of Artificial Sequence: Synthetic polypeptide"
EVQLVESGGGSVQPGGSLRLSCTASGFSLTTYNVHWVRQAPGKGLEWVGRMRYSGDTSFNAALTSRFTISRDTSKNTVYLQMNSLRAEDTATYYCASDPMYIPNYAYGVMNAWGQGTTVTVSS

SEQ ID NO: 1248 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFYYDLDFDHWGQGTMVTVSS

SEQ ID NO: 1249 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYYYDLDFDHWGQGTMVTVSS

SEQ ID NO: 1250 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSYYDLDFDHWGQGTMVTVSS

SEQ ID NO: 1251 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYYYDLDFDHWGQGTMVTVSS

SEQ ID NO: 1252 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSYYDLDFDHWGQGTMVTVSS

SEQ ID NO: 1253 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSSDLDFDHWGQGTMVTVSS

SEQ ID NO: 1254 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYSSDLDFDHWGQGTMVTVSS

SEQ ID NO: 1255 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSSDLDFDHWGQGTMVTVSS

SEQ ID NO: 1256 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSSDLDFDHWGQGTMVTVSS

SEQ ID NO: 1257 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSSDLDFDHWGQGTMVTVSS

SEQ ID NO: 1258 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWSDLDFDHWGQGTMVTVSS

SEQ ID NO: 1259 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSWSDLDFDHWGQGTMVTVSS

SEQ ID NO: 1260 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWSDLDFDHWGQGTMVTVSS

SEQ ID NO: 1261 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWSDLDFDHWGQGTMVTVSS

SEQ ID NO: 1262 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFWSDLDFDHWGQGTMVTVSS

SEQ ID NO: 1263 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYSWDLDFDHWGQGTMVTVSS

SEQ ID NO: 1264 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSSWDLDFDHWGQGTMVTVSS

SEQ ID NO: 1265 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYSWDLDFDHWGQGTMVTVSS

SEQ ID NO: 1266 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSSWDLDFDHWGQGTMVTVSS

SEQ ID NO: 1267 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFSWDLDFDHWGQGTMVTVSS

SEQ ID NO: 1268 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYTWDLDFDHWGQGTMVTVSS

SEQ ID NO: 1269 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSTWDLDFDHWGQGTMVTVSS

SEQ ID NO: 1270 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYTWDLDFDHWGQGTMVTVSS

SEQ ID NO: 1271 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSTWDLDFDHWGQGTMVTVSS

SEQ ID NO: 1272 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFTWDLDFDHWGQGTMVTVSS

SEQ ID NO: 1273 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYTTDLDFDHWGQGTMVTVSS

SEQ ID NO: 1274 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSTTDLDFDHWGQGTMVTVSS

SEQ ID NO: 1275 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYTTDLDFDHWGQGTMVTVSS

SEQ ID NO: 1276 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSTTDLDFDHWGQGTMVTVSS

SEQ ID NO: 1277 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASFTTDLDFDHWGQGTMVTVSS

SEQ ID NO: 1278 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASYWWDLDFDHWGQGTMVTVSS

SEQ ID NO: 1279 - protein, 118 aa, Artificial Sequence
  source: /note="Description of Artificial Sequence: Synthetic polypeptide"
QVQLVESGGGVVQPGRSLRLSCAASGFTFSKNGMHWVRQAPGKGLEWVAMIYYDSSKMYYADTVKGRFTISRDNSKNTLYLQMNSLRAEDTAVYYCASSWWDLDFDHWGQGTMVTVSS

SEQ ID NO: 1280 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYWWDLDFDHWGQGTMVTVSS

SEQ ID NO: 1281 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSWWDLDFDHWGQGTMVTVSS

SEQ ID NO: 1282 - protein, 118 aa, Artificial Sequence
  source: /note="Description of Artificial Sequence: Synthetic polypeptide"
QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYWWDLDFDHWGQGTMVTVSS

SEQ ID NO: 1283 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSWWDLDFDHWGQGTMVTVSS

SEQ ID NO: 1284 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASYSWDLDFDHWGQGTMVTVSS

SEQ ID NO: 1285 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASSSWDLDFDHWGQGTMVTVSS

SEQ ID NO: 1286 - protein, 118 aa, Artificial Sequence
  source: /note="Description of Artificial Sequence: Synthetic polypeptide"
QVQLVQSGAEVKKPGASVKVSCKASGFTFSKNGMHWVRQAPGQGLEWMGMIYYDSSKMYYADTVKGRVTMTRDTSTNTLYMELSSLRSEDTAVYYCASYSWDLDFDHWGQGTMVTVSS

SEQ ID NO: 1287 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASSSWDLDFDHWGQGTMVTVSS

SEQ ID NO: 1288 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGQGLEWMGMIYYDSSKMYYADTVKGRVTMTRDTSTNTLYMELSSLRSEDTAVYYCASFSWDLDFDHWGQGTMVTVSS

SEQ ID NO: 1289 - protein, 118 aa, Artificial Sequence
  source: /note="Description of Artificial Sequence: Synthetic polypeptide"
QVQLVQSGAEVKKPGASVKVSCKASGFTFSKQGMHWVRQAPGNGLEWMGMIYYDSSKMYYADTVKGRVTMTRDTSTNTLYMELSSLRSEDTAVYYCASFSWDLDFDHWGQGTMVTVSS

SEQ ID NO: 1290 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASYWWDLDFDHWGQGTMVTVSS

SEQ ID NO: 1291 - protein, 118 aa, Artificial Sequence
  source: /note="Description of Artificial Sequence: Synthetic polypeptide"
QVQLVESGGGVVQPGRSLRLSCAASGFTFSKQGMHWVRQAPGKGLEWVAMIYYDSSKMYYADTVKGRFTISRDNSKNTLYLQMNSLRAEDTAVYYCASSWWDLDFDHWGQGTMVTVSS

SEQ ID NO: 1292 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYWWDLDFDHWGQGTMVTVSS

SEQ ID NO: 1293 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSWWDLDFDHWGQGTMVTVSS

SEQ ID NO: 1294 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYWWDLDFDHWGQGTMVTVSS

SEQ ID NO: 1295 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSWWDLDFDHWGQGTMVTVSS

SEQ ID NO: 1296 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASYSWDLDFDHWGQGTMVTVSS

SEQ ID NO: 1297 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASSSWDLDFDHWGQGTMVTVSS

SEQ ID NO: 1298 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASYSWDLDFDHWGQGTMVTVSS

SEQ ID NO: 1299 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASSSWDLDFDHWGQGTMVTVSS

SEQ ID NO: 1300 - protein, 118 aa, Artificial Sequence
  source: /note="Description of Artificial Sequence: Synthetic polypeptide"
EVQLVQSGAEVKKPGESLKISCKGSGFTFSKNGMHWVRQMPGKGLEWMGMIYYDSSKMYYADTVKGQVTISRDNSINTLYLQWSSLKASDTAMYYCASFSWDLDFDHWGQGTMVTVSS

SEQ ID NO: 1301 - protein, 118 aa, Artificial Sequence
  source: /note="Description of Artificial Sequence: Synthetic polypeptide"
EVQLVQSGAEVKKPGESLKISCKGSGFTFSKQGMHWVRQMPGKGLEWMGMIYYDSSKMYYADTVKGQVTISRDNSINTLYLQWSSLKASDTAMYYCASFSWDLDFDHWGQGTMVTVSS

SEQ ID NO: 1302 - protein, 112 aa, Artificial Sequence
  source: /note="Description of Artificial Sequence: Synthetic polypeptide"
DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSHFPWTFGGGTKVEIK

SEQ ID NO: 1303 - protein, 112 aa, Artificial Sequence
  source: /note="Description of Artificial Sequence: Synthetic polypeptide"
DVVMTQSPLSLPVTLGQPASISCRSSQSLIYSIGNTYLHWYQQRPGQSPRLLIYRVSNRFSGVPDRFSGSGSGTDFTLKISRVEAEDVGVYYCFQSTHLPYTFGQGTKLEIK

SEQ ID NO: 1304 - protein, 112 aa, Artificial Sequence
  source: /note="Description of Artificial Sequence: Synthetic polypeptide"
VVVLTQTPVSLPVSLGGQASISCRSSQSLIYSIGNTYLHWYLQKPGQSPQLLIYRVSNRFSGVPDRFSGSGSGTDFTLKISRVEPEDLGDYYCFQSTHLPYTFGAGTKLELK

SEQ ID NO: 1305 - protein, 106 aa, Artificial Sequence
  source: /note="Description of Artificial Sequence: Synthetic polypeptide"
DIQMTQSPSSLSASVGDRVTITCKASQNINNYLNWYQQKPGKAPKLLIYNTDHLQAGVPSRFSGSGSGTDYTLTISSLQPEDFATYFCLQHRSRYTFGPGTKVDIK

SEQ ID NO: 1306 - protein, 106 aa, Artificial Sequence
  source: /note="Description of Artificial Sequence: Synthetic polypeptide"
DIQMTQSPSSLSASVGDRVTITCKASQNINNYLNWYQQKPGKAPKLLIYNTDHLQAGVPSRFSGSGSGTDFTLTISSLQPEDFATYYCLQHRSRYTFGPGTKVDIK

SEQ ID NO: 1307 - protein, 112 aa, Artificial Sequence
  source: /note="Description of Artificial Sequence: Synthetic polypeptide"
DVVMTQSPLSLPVTLGQPASISCRSSQSLVYSHGNTYLHWYQQRPGQSPRLLIYRVSNRFSGVPDRFSGSGSGTDFTLKISRVEAEDVGVYYCFQSTHLPYTFGQGTKLEIK

SEQ ID NO: 1308 - protein, 112 aa, Artificial Sequence
  source: /note="Description of Artificial Sequence: Synthetic polypeptide"
DVVMTQSPLSLPVTLGQPASISCRSSQSLVYSHGNTYLHWFQQRPGQSPRRLIYRVSNRFSGVPDRFSGSGSGTDFTLKISRVEAEDVGVYYCFQSTHLPYTFGQGTKLEIK

SEQ ID NO: 1309 - protein, 106 aa, Artificial Sequence
  source: /note="Description of Artificial Sequence: Synthetic polypeptide"
DIQMTQSPSSLSASVGDRVTITCKTSQNIDKYLNWYQQKPGKAPKLLIYNTNNLEAGVPSRFSGSGSGTDYTFTISSLQPEDIATYFCLQHRSSYTFGQGTKLEIK

SEQ ID NO: 1310 - protein, 107 aa, Artificial Sequence
  source: /note="Description of Artificial Sequence: Synthetic polypeptide"
DIQMTQSPSSLSASVGDRVTITCRGSQSIGNSLNWYQQKPGKAPKRLIYSTSTLEYGVPSRFSGSGSGTEYTLTISSLQPEDFATYYCLQYATYPYTFGQGTKLEIK

SEQ ID NO: 1311 - protein, 106 aa, Artificial Sequence
  source: /note="Description of Artificial Sequence: Synthetic polypeptide"
DIQMTQSPSSLSASVGDRVTITCKSSQNIDKYLNWYQQKPGKAPKLLIYNTNNLEAGVPSRFSGSGSGTDYTFTISSLQPEDIATYFCLQHRSGYTFGQGTKLEIK

SEQ ID NO: 1312 - protein, 112 aa, Artificial Sequence
  source: /note="Description of Artificial Sequence: Synthetic polypeptide"
DIVMTQTPLSSPVTLGQPASISCRSSQSLVRSDGTTYFNWLQQRPGQPPRLLIYRVSNRFSGVPDRFSGSGAGTDFTLKISRVEAEDVGVYYCLQSSHFPWTFGGGTKVEIK

SEQ ID NO: 1313 - protein, 98 aa, Artificial Sequence
  source: /note="Description of Artificial Sequence: Synthetic polypeptide"
DIVMTQTPLSSPVTLGQPASISCRSSQSLVRSDGTTYFNWYQQRPGQPPRLLIYRVSNRFSGVPDRFSGSGAGTDFTLKISRVEAEDVGVYYCLQSSH

SEQ ID NO: 1314 - protein, 112 aa, Artificial Sequence
  source: /note="Description of Artificial Sequence: Synthetic polypeptide"
DIVMTQTPLSSPVTLGQPASISCRSSQSLVRSEGTTYFNWYQQRPGQPPRLLIYRVSNRFSGVPDRFSGSGAGTDFTLKISRVEAEDVGVYYCLQSSHFPWTFGGGTKVEIK

SEQ ID NO: 1315 - protein, 112 aa, Artificial Sequence
  source: /note="Description of Artificial Sequence: Synthetic polypeptide"
DILVTQTPVSLPVSLGGHVSISCRSSQSLVRSEGTTYFNWYLQKPGQSPQLLIYRVSNRFSGVPDRFSGSGSGTDFTLKISRVEPEDLGVYYCLQSSHFPWTFGGGTKLELK

SEQ ID NO: 1316 - protein, 112 aa, Artificial Sequence
  source: /note="Description of Artificial Sequence: Synthetic polypeptide"
EIVLTQSPGTLSLSPGERATLSCRSSQSLVRSEGTTYFNWYQQKPGQAPRLLIYRVSNRFSGIPDRFSGSGSGTDFTLTISRLEPEDLAVYYCLQSSHFPWTFGGGTKVEIK

SEQ ID NO: 1317 - protein, 112 aa, Artificial Sequence
  source: /note="Description of Artificial Sequence: Synthetic polypeptide"
DIQMTQSPSSLSASVGDRVTITCRSSQSLVRSEGTTYFNWYQQKPGKAPKLLIYRVSNRFSGVPSRFSGSGSGTDFTLTISSLQPEDFATYYCLQSSHFPWTFGGGTKVEIK

SEQ ID NO: 1318 - protein, 106 aa, Artificial Sequence
  source: /note="Description of Artificial Sequence: Synthetic polypeptide"
EIVMTQSPSTLSASVGDRVIITCKASQNINNYLNWYQQKPGKAPKLLIYNTDHLQAGVPSRFSGSGSGAEFTLTISSLQPDDFATYYCLQHRSRYTFGQGTKLTVL

SEQ ID NO: 1319 - protein, 112 aa, Artificial Sequence
  source: /note="Description of Artificial Sequence: Synthetic polypeptide"
EIVLTQSPGTLSLSPGERATLSCRSSQSLVRSDGTTYFNWYQQKPGQAPRLLIYRVSNRFSGIPDRFSGSGSGTDFTLTISRLEPEDLAVYYCLQSSHFPWTFGGGTKVEIK

SEQ ID NO: 1320 - protein, 112 aa, Artificial Sequence
  source: /note="Description of Artificial Sequence: Synthetic polypeptide"
DIQMTQSPSSLSASVGDRVTITCRSSQSLVRSDGTTYFNWYQQKPGKAPKLLIYRVSNRFSGVPSRFSGSGSGTDFTLTISSLQPEDFATYYCLQSSHFPWTFGGGTKVEIK

SEQ ID NO: 1321 - protein, 719 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1322 - protein, 326 aa, Artificial Sequence
  source: /note="Description of Artificial Sequence: Synthetic polypeptide"
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1323 - protein, 719 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKNTAYLQMNSLKTEDTAVYYCVRHGNFGNSYVSWFAHWGQGTLVTVSSGGGGSGGGGSGGGGSGGGGSQAVVTQEPSLTVSPGGTVTLTCGSSTGAVTSSNYANWVQQKPGQAPRGLIGGTNKRAPWTPARFSGSLLGGKAALTLSGAQPEDEAEYYCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1324 - protein, 719 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTAYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1325 - protein, 718 aa, Artificial Sequence
  source: /note="Description of Artificial Sequence: Synthetic polypeptide"
EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1326 - protein, 365 aa, Artificial Sequence
  source: /note="Description of Artificial Sequence: Synthetic polypeptide"
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1327 - protein, 450 aa, Artificial Sequence
  source: /note="Description of Artificial Sequence: Synthetic polypeptide"
QVQLVQSGAEVKKPGASVKVSCKASGYTFTTYWIQWVRQAPGQRLEWMGAVYPGDADTRYTQKFQGRVTLTADRSASTAYMELSSLRSEDTAVYYCGRDAGLEYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1328 - protein, 486 aa, Artificial Sequence
  source: /note="Description of Artificial Sequence: Synthetic polypeptide"
EVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1329 - protein, 449 aa, Artificial Sequence
  source: /note="Description of Artificial Sequence: Synthetic polypeptide"
EVQLVQSGAEVKKPGESLKISCKASGYSFTNYWMNWVRQMPGKGLEWMGMIHPSDSEIRLNQKFQGQVTLSVDKSIGTAYMQWSSLKASDTAMYYCSRWYYLSSPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVAVSHEDPEVKFNWYVDGVEVHNAKTKPREEQYASTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1330 - protein, 719 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSGGGGSEVQLVESGGGLVQPGGSLKLSCAASGFTFNTYAMNWVRQASGKGLEWVGRIRSKYNNYATYYADSVKDRFTISRDDSKSTLYLQMNSLKTEDTAVYYCVRHGNFGNSYVSWFAYWGQGTLVTVSSGGGGSGGGGSGGGGSGGGGSQAVVTQEPSLTVSPGGTVTLTCRSSTGAVTTSNYANWVQQKPGQAPRGLIGGTNKRAPWTPARFSGSLLGDKAALTLSGAQPEDEAEYFCALWYSNLWVFGGGTKLTVLGGGGSDKTHTCPPCPAPELLGGPSVFLFPPKPKDTLMISRTPEVTCVVVAVSHEDPEVKFNWYVDGVEVHNAKTKPREEQYGSTYRVVSVLTVLHQDWLNGKEYKCKVSNKALAAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1331 - protein, 418 aa, Artificial Sequence
  source: /note="Description of Artificial Sequence: Synthetic polypeptide"
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRGGGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1332 - protein, 323 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYECESPNITDTMKFFLYVLESGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1333 - protein, 323 aa, Artificial Sequence
  source: /note="Description of Artificial Sequence: Synthetic polypeptide"
SQQIYGVVYGNVTFHVPSNVPLKECLWKKQKDKVAELENSEFRAFSSFKNRVYLDTVSCSLTIYNLTSSDEDEYEMESPNITDTMKFFLYVLESGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1334 - protein, 323 aa, Artificial Sequence
  source: /note="Description of Artificial Sequence: Synthetic polypeptide"
SQQIYGVVYGNVTFHCPSNVPLKEVLWKKQKDKVAELENSEFRAFSSFKNRVYLDTVSGSLTIYNLTSSDEDEYEMESPNITDTCKFFLYVLESGSDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1335 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1336 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1337 - protein, 227 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNRYTQKSLSLSPGK

SEQ ID NO: 1338 - protein, 225 aa, Artificial Sequence
  source: /note="Description of Artificial Sequence: Synthetic polypeptide"
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSP

What is claimed is:

1. A CD2 binding molecule comprising a variant CD58 domain whose amino acid sequence comprises the amino acid sequence of SEQ ID NO:8, SEQ ID NO:9, SEQ ID NO:10, or SEQ ID NO: 11.

2. The CD2 binding molecule of claim 1, which is a bispecific binding molecule (BBM).

3. A conjugate comprising (a) the CD2 binding molecule of claim 1, and (b) an agent.

4. The conjugate of claim 3, wherein the agent is a therapeutic agent, a diagnostic agent, a masking moiety, a cleavable moiety, a stabilizing moiety or any combination thereof.

5. A pharmaceutical composition comprising the CD2 binding molecule of claim 1 and a pharmaceutically acceptable excipient.

6. A method of treating an immune or inflammatory disorder, comprising administering to a subject in need thereof the CD2 binding molecule of claim 1.

7. A method of treating a subject with cancer, comprising administering to a subject suffering from cancer an effective amount of the CD2 binding molecule of claim 1.

8. The method of claim 7, wherein the cancer is HER2+ cancer, acute lymphoblastic leukemia (ALL), acute myeloid leukemia (AML), adrenocortical carcinoma, anal cancer, appendix cancer, astrocytoma, basal cell carcinoma, brain tumor, bile duct cancer, bladder cancer, bone cancer, breast cancer, bronchial tumor, Burkitt Lymphoma, carcinoma of unknown primary origin, cardiac tumor, cervical cancer, chordoma, chronic lymphocytic leukemia (CLL), chronic myelogenous leukemia (CML), chronic myeloproliferative neoplasm, colon cancer, colorectal cancer, craniopharyngioma, cutaneous T-cell lymphoma, ductal carcinoma, embryonal tumor, endometrial cancer, ependymoma, esophageal cancer, esthesioneuroblastoma, fibrous histiocytoma, Ewing sarcoma, eye cancer, germ cell tumor, gallbladder cancer, gastric cancer, gastrointestinal carcinoid tumor, gastrointestinal stromal tumor, gestational trophoblastic disease, glioma, head and neck cancer, hairy cell leukemia, hepatocellular cancer, histiocytosis, Hodgkin lymphoma, hypopharyngeal cancer, intraocular melanoma, islet cell tumor, Kaposi sarcoma, kidney cancer, Langerhans cell histiocytosis, laryngeal cancer, leukemia, lip and oral cavity cancer, liver cancer, lobular carcinoma in situ, lung cancer, lymphoma, macroglobulinemia, malignant fibrous histiocytoma, melanoma, Merkel cell carcinoma, mesothelioma, metastatic squamous neck cancer with occult primary, midline tract carcinoma involving NUT gene, mouth cancer, multiple endocrine neoplasia syndrome, multiple myeloma, mycosis fungoides, myelodysplastic syndrome, myelodysplastic/myeloproliferative neoplasm, nasal cavity and para-nasal sinus cancer, nasopharyngeal cancer, neuroblastoma, non-Hodgkin lymphoma, non-small cell lung cancer, oropharyngeal cancer, osteosarcoma, ovarian cancer, pancreatic cancer, papillomatosis, paraganglioma, parathyroid cancer, penile cancer, pharyngeal cancer, pheochromocytomas, pituitary tumor, pleuropulmonary blastoma, primary central nervous system lymphoma, prostate cancer, rectal cancer, renal cell cancer, renal pelvis and ureter cancer, retinoblastoma, rhabdoid tumor, salivary gland cancer, Sezary syndrome, skin cancer, small cell lung cancer, small intestine cancer, soft tissue sarcoma, spinal cord tumor, stomach cancer, T-cell lymphoma, teratoid tumor, testicular cancer, throat cancer, thymoma and thymic carcinoma, thyroid cancer, urethral cancer, uterine cancer, vaginal cancer, vulvar cancer, or Wilms tumor.

9. A nucleic acid or plurality of nucleic acids encoding the CD2 binding molecule of claim 1.

10. A cell engineered to express the CD2 binding molecule of claim 1.

11. A cell comprising one or more nucleic acid sequences encoding the CD2 binding molecule of claim 1 under the control of one or more promoters.

12. A method of producing a CD2 binding molecule, comprising:
  (a) culturing the cell of claim 10 or claim 11 in conditions under which the CD2 binding molecule is expressed; and (b) recovering the CD2 binding molecule from the cell culture.

13. The CD2 binding molecule of claim 1, wherein the amino acid sequence of the variant CD58 domain comprises the amino acid sequence of SEQ ID NO:8.

14. The CD2 binding molecule of claim 1, wherein the amino acid sequence of the variant CD58 domain comprises the amino acid sequence of SEQ ID NO:9.

15. The CD2 binding molecule of claim 1, wherein the amino acid sequence of the variant CD58 domain comprises the amino acid sequence of SEQ ID NO:10.

16. The CD2 binding molecule of claim 1, wherein the amino acid sequence of the variant CD58 domain comprises the amino acid sequence of SEQ ID NO:11.

* * * * *